US011382954B2

(12) United States Patent
Perret et al.

(10) Patent No.: US 11,382,954 B2
(45) Date of Patent: Jul. 12, 2022

(54) BINDING PROTEINS SPECIFIC FOR RAS NEOANTIGENS AND USES THEREOF

(71) Applicant: FRED HUTCHINSON CANCER CENTER, Seattle, WA (US)

(72) Inventors: Rachel Perret, Wellington (NZ); Philip D. Greenberg, Mercer Island, WA (US); Thomas M. Schmitt, Seattle, WA (US); Aude G. Chapuis, Seattle, WA (US); Ingunn M. Stromnes, Kenmore, WA (US); Tijana Martinov, Seattle, WA (US)

(73) Assignee: FRED HUTCHINSON CANCER CENTER, Seattle, WA (US)

( * ) Notice: Subject to any disclaimer, the term of this patent is extended or adjusted under 35 U.S.C. 154(b) by 0 days.

(21) Appl. No.: 17/408,340

(22) Filed: Aug. 20, 2021

(65) Prior Publication Data

US 2021/0379150 A1    Dec. 9, 2021

Related U.S. Application Data

(63) Continuation of application No. PCT/US2020/018904, filed on Feb. 19, 2020.

(60) Provisional application No. 62/808,248, filed on Feb. 20, 2019.

(51) Int. Cl.
*A61K 38/17* (2006.01)
*A61P 35/00* (2006.01)
*A61K 35/17* (2015.01)

(52) U.S. Cl.
CPC .......... *A61K 38/1774* (2013.01); *A61K 35/17* (2013.01); *A61P 35/00* (2018.01)

(58) Field of Classification Search
CPC .................................................. A61K 38/1774
See application file for complete search history.

(56) References Cited

U.S. PATENT DOCUMENTS

| | | | |
|---|---|---|---|
| 5,283,173 A | 2/1994 | Fields et al. | |
| 5,420,032 A | 5/1995 | Marshall et al. | |
| 5,468,614 A | 11/1995 | Fields et al. | |
| 6,410,319 B1 | 6/2002 | Raubitschek et al. | |
| 6,833,252 B1 | 12/2004 | Dujon et al. | |
| 7,446,191 B2 | 11/2008 | Jensen | |
| 7,514,537 B2 | 4/2009 | Jensen | |
| 7,709,002 B1 | 5/2010 | Schlom et al. | |
| 8,119,772 B2 | 2/2012 | Yang et al. | |
| 8,697,359 B1 | 4/2014 | Zhang | |
| 8,822,647 B2 | 9/2014 | Jensen | |
| 9,574,000 B2 | 2/2017 | Langermann et al. | |
| 2004/0002092 A1 | 1/2004 | Arnould et al. | |
| 2004/0087025 A1 | 5/2004 | June et al. | |
| 2006/0078552 A1 | 4/2006 | Arnould et al. | |
| 2006/0153826 A1 | 7/2006 | Arnould et al. | |
| 2006/0206949 A1 | 9/2006 | Arnould et al. | |
| 2007/0117128 A1 | 5/2007 | Smith et al. | |
| 2011/0189141 A1 | 8/2011 | Kieback et al. | |
| 2011/0243972 A1 | 10/2011 | Jaffee | |
| 2011/0301073 A1 | 12/2011 | Gregory et al. | |
| 2014/0068797 A1 | 3/2014 | Doudna et al. | |
| 2014/0186843 A1 | 7/2014 | Zhang et al. | |
| 2017/0304421 A1* | 10/2017 | Wang | A61P 35/00 |
| 2018/0134804 A1* | 5/2018 | Scheinberg | C07K 16/40 |
| 2018/0273602 A1 | 9/2018 | Alten et al. | |
| 2019/0119350 A1* | 4/2019 | Lu | C07K 14/7051 |

FOREIGN PATENT DOCUMENTS

| | | | |
|---|---|---|---|
| DE | WO2014118236 | * | 8/2014 |
| WO | 97/09433 A1 | | 3/1997 |
| WO | 2010/065818 A1 | | 6/2010 |
| WO | 2010/084158 A1 | | 7/2010 |
| WO | 2013/025779 A1 | | 2/2013 |
| WO | 2014/031687 A1 | | 2/2014 |
| WO | 2015/071474 A9 | | 5/2015 |
| WO | 2015/086590 A2 | | 6/2015 |
| WO | 2016/040724 A1 | | 3/2016 |
| WO | 2016/054638 A1 | | 4/2016 |
| WO | 2016/134333 A9 | | 8/2016 |
| WO | 2016/154246 A1 | | 9/2016 |
| WO | 2017/021526 A1 | | 2/2017 |
| WO | 2017/173321 A1 | | 10/2017 |
| WO | 2017/192924 A1 | | 11/2017 |
| WO | 2018/058002 A1 | | 3/2018 |
| WO | 2018/213467 A1 | | 11/2018 |
| WO | 2019/112941 A1 | | 6/2019 |
| WO | 2020/037239 A1 | | 2/2020 |
| WO | 2020/154617 A1 | | 7/2020 |
| WO | 2021/097365 A2 | | 5/2021 |

OTHER PUBLICATIONS

Lu et al. (Human Gene Therapy 21:75-86 (Jan. 2010)). (Year: 2010).*
Xu et al. (Aids Research and Human Retroviruses vol. 20, No. 5, 2004, pp. 557-564). (Year: 2004).*
Tan et al. (Journal of Virology, Nov. 2008, p. 10986-10997) (Year: 2008).*
Tammana et al. (Human Gene Therapy 21:75-86 (Jan. 2010)). (Year: 2010).*
Lu et al. (Molecular Medicine Reports 14: 4999-5006, 2016). (Year: 2016).*
Graham et al. (Cells 2018, 7, 155; doi:10.3390/cells7100155). (Year: 2018).*

(Continued)

*Primary Examiner* — Scott Long
(74) *Attorney, Agent, or Firm* — Seed IP Law Group LLP

(57) ABSTRACT

The present disclosure provides compositions and methods for targeting a Ras antigen to, for example, treat or prevent cancer. Disclosed embodiments include binding proteins, such as a T cell receptor or a chimeric antigen receptor, that bind to a Ras antigen:HLA complex. Polynucleotides encoding such binding protein can introduced into a host cell, such as a T cell, and the cell can be used in immunotherapy for treating various cancers. Also provided are immunogenic polypeptides that can be useful to, for example, induce an immune response against a mutated Ras or to identify a binding protein that binds to a Ras antigen.

30 Claims, 127 Drawing Sheets

Specification includes a Sequence Listing.

(56) References Cited

OTHER PUBLICATIONS

Database Geneseq [Online], "Antigenic peptide, SEQ ID 73," XP-002799064, Accession No. BFQ36047, Oct. 18, 2018, (1 page).
International Search Report and Written Opinion, dated Aug. 3, 2020, for International Application No. PCT/US2020/018904, (17 pages).
Al-Shibli et al., "Prognostic Effect of Epithelial and Stromal Lymphocyte Infdtration in Non-Small Cell Lung Cancer," *Clin. Cancer Res.* 14(16):5220-5227, Aug. 15, 2008, (9 pages).
Altschul et al., "Gapped BLAST and PSI-BLAST: a new generation of protein database search programs," *Nucleic Acids Research* 25(17):3389-3402, 1997.
Anagnostou et al., "Evolution of Neoantigen Landscape during Immune Checkpoint Blockade in Non-Small Cell Lung Cancer," *Cancer Discovery* 7(3):264-276, Mar. 2017, (14 pages).
Arbabi-Ghahroudi, "Camelid Single-Domain Antibodies: Historical Perspective and Future Outlook," *Frontiers in Immunology* 8(1589), Nov. 20, 2017, (8 pages).
Argast et al., "I-Ppo1 and I-Cre1 Homing Site Sequence Degeneracy Determined by Random Mutagenesis and Sequential in Vitro Enrichment," *J. Mol. Biol.* 280:345-353, 1998.
Ashouri et al., "Endogenous Nur77 Is a Specific Indicator of Antigen Receptor Signaling in Human T and B Cells," *The Journal of Immunology* 198:651-668, 2017, (13 pages).
Ashworth et al., "Computational redesign of endonuclease DNA binding and cleavage specificity," *Nature* 441(7093):656-659, Jun. 1, 2006, (11 pages).
Belfort et al., "Homing endonucleases: keeping the house in order," *Nucleic Acids Research* 25(17):3379-3388, 1997.
Betts et al., "The Functional Profile of Primary Human Antiviral CD8$^+$T Cell Effector Activity Is Dictated by Cognate Peptide Concentration," *The Journal of Immunology* 17 2:6407-6417, 2004. (13 pages).
Borst et al., "The T3 Complex on Human T Lymphocytes Involves Four Structurally Distinct Glycoproteins," *The Journal of Biological Chemistry* 258(8):5135-5141, 1983.
Bowerman et al., "Engineering the Binding Properties of the T Cell Receptor:Peptide:MHC Ternary Complex that Governs T Cell Activity," *Mol. Immunol.* 46(15):3000-3008, Sep. 2009, (23 pages).
Brentjens et al., "Genetically Targeted T Cells Eradicate Systemic Acute Lymphoblastic Leukemia Xenografts," *Clin. Cancer Res.* 13(18):5426-5435, Sep. 15, 2007.
Cawthon et al., "Peptide Requirement for CTL Activation Reflects the Sensitivity to CD3 Engagement: Correlation with CD8ab Versus CD8aa Expression," *The Journal of Immunology* 167:2577-2584, 2001. (9 pages).
Chevalier et al., "Design, Activity, and Structure of a Highly Specific Artificial Endonuclease," *Molecular Cell* 10:895-905, Oct. 2002.
Chothia, et al., "The outline structure of the T-cell ab receptor," *The EMBO Journal* 7(12):3745-3755, 1988.
Cibulskis et al., "Sensitive detection of somatic point mutations in impure and heterogeneous cancer samples," *Nature Biotechnology* 31(3):213-219, Mar. 2013. (9 pages).
Cole et al., "CD8: Adhesion Molecule, Co-Receptor and Immuno-Modulator," *Cellular & Molecular Immunology* 1(2):81-88, Apr. 2004.
Dangaj et al., "Novel Recombinant Human B7-H4 Antibodies Overcome Tumoral Immune Escape to Potentiate T-Cell Antitumor Responses," *Cancer Res.* 73(15):4820-4829, Aug. 1, 2013. (11 pages).
Database Geneseq, "Human HER2 mutant polypeptide, SEQ ID: 1740," XP-002796274, retrieved from EBI accession No. GS PROT:BEJ03246, Nov. 16, 2017. (1 page).
Database Geneseq, "Human RAS protein G12V mutant peptide, SEQ ID 12," XP-002796276, retrieved from EBI accession No. NR_PAT_PROT:BCA75211, Jul. 30, 2015. (1 page).

Database Geneseq, "p113 (p21 ras fragment 1-25, G12V)," XP-002796275, retrieved from EBI accession No. GS_PROT:AAR26736, Feb. 9, 1993. (1 page).
Desjarlais et al., "Use of a zinc-finger consensus sequence framework and specificity rules to design specific DNA binding proteins," *Proc. Natl. Acad. Sci. USA* 90:2256-2260, Mar. 1993.
Di Stasi et al., "Inducible Apoptosis as a Safety Switch for Adoptive Cell Therapy," *N. Engl. J. Med.* 365(18):1673-1683, Nov. 3, 2011. (16 pages).
Dossett et al., "Adoptive Immunotherapy of Disseminated Leukemia With TCR-transduced, CD8$^+$T Cells Expressing a Known Endogenous TCR," *Molecular Therapy* 17(4):742-749, Apr. 2009.
Dujon et al., "Mobile introns: definition of terms and recommended nomenclature," *Gene* 82:115-118, 1989.
Dunbar et al., "ANARCI: antigen receptor numbering and receptor classification," *Bioinformatics* 32(2):298-300, 2016.
Engels et al., "Retroviral Vectors for High-Level Transgene Expression in T Lymphocytes," *Human Gene Therapy* 14:1155-1168, Aug. 10, 2003.
Epinat et al., "A novel engineered meganuclease induces homologous recombination in yeast and mammalian cells," *Nucleic Acids Research* 31(11):2952-2962, 2003.
Eyquem et al., "Targeting a CAR to the TRAC locus with CRISPR/Cas9 enhances tumour rejection," *Nature* 543:113-117, Mar. 2, 2017. (19 pages).
Fehse et al., "CD34 Splice Variant: An Attractive Marker for Selection of Gene-Modified Cells," *Molecular Therapy* 1(5):448-456, May 2000.
Floros et al., "Anticancer Cytokines: Biology and Clinical Effects of IFN-$\alpha$2, IL-2, IL-15, IL-21, and IL-12," *Semin. Oncol.* 42(4):539-548, Aug. 2015. (17 pages).
Frecha et al., "Advances in the Field of Lentivector-based Transduction of T and B Lymphocytes for Gene Therapy," *Molecular Therapy* 18(10):1748-1757, Oct. 2010.
Gao et al., "Molecular interactions of coreceptor CD8 and MHC class I: the molecular basis for functional coordination with the T-cell receptor," *Immunology Today* 21(12):630-636, Dec. 2000.
Gimble et al., "Substrate Recognition and Induced DNA Distortion by the PI-ScelI Endonuclease, an Enzyme Generated by Protein Splicing," *J. Mol. Biol.* 263:163-180, 1996.
Govers et al., "T cell receptor gene therapy: strategies for optimizing transgenic TCR pairing," *Trends in Molecular Medicine* 16(2):77-87, 2010.
Green et al., "Mitochondria and Apoptosis," *Science* 281:1309-1312, Aug. 28, 1998.
Harris et al., "Adoptive T Cell Therapies: A Comparison of T Cell Receptors and Chimeric Antigen Receptors," *Trends in Pharmacological Scienecs* 37(3):220-230, Mar. 2016.
Hiraoka et al., "Concurrent infiltration by CD8$^+$T cells and CD4$^+$T cells is a favourable prognostic factor in non-small-cell lung carcinoma," *British Journal of Cancer* 94(2):275-280, 2006.
Ho et al., "In vitro methods for generating CD8$^+$T-cell clones for immunotherapy from the naive repertoire," *Journal of Immunological Methods* 310:40-52, 2006.
International Search Report and Written Opinion, dated Jan. 17, 2020, for International Application No. PCT/US2019/047550. (16 pages).
Jasin, "Genetic manipulation of genomes with rare-cutting endonucleases," *TIG* 12(6):224-228, Jun. 1996.
Jinek et al., "A Programmable Dual-RNA-Guided DNA Endonuclease in Adaptive Bacterial Immunity," *Science* 337:816-821, Aug. 17, 2012.
Jones et al., "Lentiviral Vector Design for Optimal T Cell Receptor Gene Expression in the Transduction of Peripheral Blood Lymphocytes and Tumor-Infiltrating Lymphocytes," *Human Gene Therapy* 20:630-640, Jun. 2009.
Jores et al., "Resolution of hypervariable regions in T-cell receptor Beta chains by a modified Wu-Kabat index of amino acid diversity," *Proc. Natl. Acad. Sci. USA* 87:9138-9142, Dec. 1990.
Kargl et al., "Neutrophils dominate the immune cell composition in non-small cell lung cancer," *Nature Communications* 8:14381, Feb. 1, 2017. (11 pages).

(56) References Cited

OTHER PUBLICATIONS

Kieback et al., "A safeguard eliminates T cell receptor gene-modified autoreactive T cells after adoptive transfer," *PNAS* 105(2):623-628, Jan. 15, 2008.

Kreiter et al., "Increased Antigen Presentation Efficiency by Coupling Antigens to MHC Class I Trafficking Signals," *The Journal of Immunology* 180:309-318, 2008. (12 pages).

Kreiter et al., "Mutant MHC class II epitopes drive therapeutic immune responses to cancer," *Nature* 520:692-696, Apr. 30, 2015. (17 pages).

Krisky et al., "Development of herpes simplex virus replication-defective multigene vectors for combination gene therapy applications," *Gene Therapy* 5:1511-1530, 1998.

Kuball et al., "Facilitating matched pairing and expression of TCR chains introduced into human T cells," *Blood* 109(6):2331-2338, Mar. 15, 2007. (17 pages).

Langenkamp et al., "T cell priming by dendritic cells: thresholds for proliferation, differentiation and death and intraclonal functional diversification," *Eur. J. Immunol.* 32:2046-2054, 2002.

Leen et al., "Improving T Cell Therapy for Cancer" *Annu. Rev. Immunol.* 25:243-265, 2007. (26 pages).

Lefranc et al., "IMGT unique numbering for immunoglobulin and T cell receptor variable domains and Ig superfamily V-like domains," *Developmental and Comparative Immunology* 27:55-77, 2003.

Li et al., "Fast and accurate short read alignment with Burrows-Wheeler transform," *Bioinformatics* 25(14):1754-1760, 2009.

Li et al., "RSEM: accurate transcript quantification from RNA-Seq data with or without a reference genome," *BMC Bioinformatics* 12:323, 2011. (16 pages).

Li, "Aligning sequence reads, clone sequences and assembly contigs with BWA-MEM," arXiv preprint, arXiv:1303.3997v2., May 26, 2013. (3 pages).

Liebl et al., "Transfer of *Brevibacterium divaricatum* DSM 20297$^T$, "*Brevibacterium flavum*" DSM 20411, "*Brevibacterium lactofermentum*" DSM 20412 and DSM 1412, and *Corynebacterium lilium* DSM 20137$^T$ to *Corynebacterium glutamicum* and Their Distinction by rRNA Gene Restriction Patterns," *International Journal of Systematic Bacteriology* 41(2):255-260, Apr. 1991.

Lim et al., "Hepatitis B virus nuclear export elements: RNA stem-loop a and ft, key parts of the HBV post-transcriptional regulatory element," *RNA Biology* 13(9):143-141, 2016, (6 pages).

Linnemann et al., "High-throughput epitope discovery reveals frequent recognition of neo-antigens by CD4$^+$T cells in human melanoma," *Nature Medicine* 21(1):81-85, Jan. 2015, (8 pages).

Liu et al., "Selective inhibition of IDO1 effectively regulates mediators of antitumor immunity," *Blood* 115(17):3520-3530, Apr. 29, 2010. (12 pages).

Lu et al., "Efficient Identification of Mutated Cancer Antigens Recognized by T Cells Associated with Durable Tumor Regressions," *Clin. Cancer Res.* 20(13):3401-3410, Jul. 1, 2014. (11 pages).

Marty et al., "MHC-I Genotype Restricts the Oncogenic Mutational Landscape," *Cell* 171:1272-1283, Nov. 30, 2017. (28 pages).

Mautino et al., "Abstract 491: NLG919, a novel indoleamine-2,3-dioxygenase (IDO)-pathway inhibitor drug candidate for cancer therapy," *Cancer Res.* 73(8 Suppl):Abstract nr 491, Apr. 2013. (4 pages).

Mavilio et al., "Peripheral Blood Lymphocytes as Target Cells of Retroviral Vector-Mediated Gene Transfer," *Blood* 83(7):1988-1997, Apr. 1, 1994, (11 pages).

McGranahan et al., "Clonal neoantigens elicit T cell immunoreactivity and sensitivity to immune checkpoint blockade," *Science* 351(6280):1463-1469, Mar. 25, 20163. (13 pages).

McKenna et al., "The Genome Analysis Toolkit: A MapReduce framework for analyzing next-generation DNA sequencing data," *Genome Research* 20:1297-1303, 2010.

Ott et al., "An immunogenic personal neoantigen vaccine for patients with melanoma," *Nature* 547:217-221, Jul. 13, 2017. (22 pages).

Paques et al., "Meganucleases and DNA Double-Strand Break-Induced Recombination: Perspectives for Gene Therapy," *Current Gene Therapy* 7(1):49-66, 2007.

Perler et al., "Protein splicing elements: inteins and exteins—a definition of terms and recommended nomenclature," *Nucleic Acids Research* 22(7):1125-1127, 1994.

Philip et al., "A highly compact epitope-based marker/suicide gene for easier and safer T-cell therapy," *Blood* 124(8):1277-1287, Aug. 21, 2014. (12 pages).

Philip et al., "Chromatin states define tumour-specific T cell dysfunction and reprogramming," *Nature* 545:452-456, May 25, 2017. (21 pages).

Porteus et al., "Gene targeting using zinc finger nucleases," *Nature Biotechnology* 23(8):967-973, Aug. 2005.

Ramos et al., "Oncotator: cancer variant annotation tool," *Hum. Mutat.* 36(4):E2423-E2429, Apr. 2015, (9 pages).

Ren et al., "Multiplex Genome Editing to Generate Universal CAR T Cells Resistant to PD1 Inhibition," Clin. Cancer Res. 23(9):2255-2266, May 1, 2017. (13 pages).

Riddell et al., "The use of anti-CD3 and anti-CD28 monoclonal antibodies to clone and expand human antigen-specific T cells," *Journal of Immunological Methods* 128:189-201, 1990.

Rizvi et al., "Mutational landscape determines sensitivity to PD-1 blockade in non-small cell lung cancer," *Science* 348(6230):124-128, Apr. 3, 2015. (6 pages).

Robins et al., "Comprehensive assessment of T-cell receptor β-chain diversity in αβ T cells," *Blood* 114(19):4099-4107, Nov. 5, 2009.

Robins et al., "Overlap and Effective Size of the Human CD8+ T Cell Receptor Repertoire," *Science Translational Medicine* 2(47):47ra64, Sep. 1, 2010. (9 pages).

Robins et al., "Ultra-sensitive detection of rare T cell clones," *J. Immunol. Methods* 375:14-19, Jan. 31, 2012. (9 pages).

Sadelain et al., "The basic principles of chimeric antigen receptor (CAR) design," *Cancer Discov.* 3(4):388-398, Apr. 2013. (21 pages).

Saunders et al., "Strelka: accurate somatic small-variant calling from sequenced tumor-normal sample pairs," *Bioinformatics* 28(14):1811-1817, 2012.

Scatchard, "The Attractions of Proteins for Small Molecules and Ions," *Annals New York Academy of Sciences* 51(4):660-672, May 1949.

Schmitt et al., "T Cell Receptor Gene Therapy for Cancer," *Human Gene Therapy* 20:1240-1248, Nov. 2009.

Scholten et al., "Codon modification of T cell receptors allows enhanced functional expression in transgenic human T cells," *Clinical Immunology* 119:135-145, 2006.

Schumacher et al., "Neoantigens in cancer immunotherapy," *Science* 348(6230):69-74, Apr. 3, 2015. (7 pages).

Seeliger et al., "Boosting antibody developability through rational sequence optimization," *mAbs* 7(3):505-515, May/Jun. 2015.

Spitzer et al., "Systemic Immunity Is Required for Effective Cancer Immunotherapy," *Cell* 168:487-502, e1-e5, Jan. 26, 2017. (32 pages).

Stone et al., "A novel T cell receptor single-chain signaling complex mediates antigen-specific T cell activity and tumor control," *Cancer Immunol. Immunother.* 63:1163-1176, 2014.

Straathof et al., "An inducible caspase 9 safety switch for T-cell therapy," *Blood* 105(11):4247-4254, Jun. 1, 2005. (20 pages).

Sussman et al., "Isolation and Characterization of New Homing Endonuclease Specificities at Individual Target Site Positions," *J. Mol. Biol.* 342:31-41, 2004.

Takase et al., "Highly sensitive detection of a HER2 12-base pair duplicated insertion mutation in lung cancer using the Eprobe-PCR method," *PLoS ONE* 12(2):e0171225, Feb. 2, 2017. (13 pages).

Terentis et al., "The Selenazal Drug Ebselen Potently Inhibits Indoleamine 2,3-Dioxygenase by Targeting Enzyme Cysteine Residues," *Biochemistry* 49(3):591-600, 2010.

Till et al., "Adoptive immunotherapy for indolent non-Hodgkin lymphoma and mantle cell lymphoma using genetically modified autologous CD20-specific T cells," *Blood* 112(6):2261-2271, Sep. 15, 2008 (25 pages).

Torikai et al., "A foundation for universal T-cell based immunotherapy: T cells engineered to express a CD19-specific chimeric-antigen-

(56) References Cited

OTHER PUBLICATIONS receptor and eliminate expression of endogenous TCR," *Blood* 119(24)3691-5105, Jun. 14, 2012, (10 pages).
Torikai et al., "Genetic editing of HLA expression in hematopoietic stem cells to broaden their human application," *Scientific Reports* 6:21757, Feb. 23, 2016, (11 pages).
Torikai et al., "Toward eliminating HLA class I expression to generate universal cells from allogeneic donors," *Blood* 122(8):1341-1349, Aug. 22, 2013. (10 pages).
Tran et al., "Cancer Immunotherapy Based on Mutation-Specific CD4+T Cells in a Patient with Epithelial Cancer," *Science* 344(6184):641-645, May 9, 2014, (6 pages).
Van der Auwera et al., "From FastQ data to high confidence variant calls: the Genome Analysis Toolkit best practices pipeline," *Curr. Protoc. Bioinformatics* 11(1110):11.10.1-11.10.33, Oct. 15, 2013. (43 pages).
Veatch et al., "Tumor infiltrating $BRAF^{V600E}$-specific CD4+T cells correlated with complete clinical response in melanoma," *The Journal of Clinical Investigation* 128(4):1563-1568, Apr. 2018.
Verhoeyen et al., "Lentiviral Vector Gene Transfer into Human T Cells," *Methods in Molecular Biology, Methods and Protocols* 506:97-114, 2009.
Viola et al., "T Cell Activation Determined by T Cell Receptor Number and Tunable Thresholds," *Science* 273:104-106, Jul. 5, 1996.
Wakabayashi et al., "CD4+T cells in cancer stroma, not CD8+T cells in cancer cell nests, are associated with favorable prognosis in human non-small cell lung cancers," *Cancer Sci.* 94(11):1003-1009, Nov. 2003.
Wälchli et al., "A Practical Approach to T-Cell Receptor Cloning and Expression," *PLoS ONE* <6(11):e27930, Nov. 21, 2011. (11 pages).
Walseng et al., "A TCR-based Chimeric Antigen Receptor," *Scientific Reports* 7:10713, 2017. (10 pages).
Walseng et al., "Soluble T-Cell Receptors Produced in Human Cells for Targeted Delivery," *PLoS ONE* 10(4):e0119559, Apr. 13, 2015. (15 pages).
Wang et al., "A transgene-encoded cell surface polypeptide for selection, in vivo tracking, and ablation of engineered cells," *Blood* 118(5):1255-1263, Aug. 4, 2011. (10 pages).
Wang et al., "Optimizing Adoptive Polyclonal T Cell Immunotherapy of Lymphomas, Using a Chimeric T Cell Receptor Possessing CD28 and CD137 Costimulatory Domains," *Human Gene Therapy* 18:712-725, Aug. 2007. (16 pages).
Warren et al., "Exhaustive T-cell repertoire sequencing of human peripheral blood samples reveals signatures of antigen selection and a directly measured repertoire size of at least 1 million clonotypes," *Genome Research* 21:790-797, 2011, (9 pages).
Wilson, "Analyzing Biomolecular Interactions," *Science* 295(5562):2103-2105, Mar. 15, 2002. (3 pages).
Wolfe et al., "Analysis of Zinc Fingers Optimized via Phage Display: Evaluating the Utility of a Recognition Code," *J. Mol. Biol.* 285:1917-1934, 1999.
Wolff et al., "Monoclonal Antibody Homodimers: Enhanced Antitumor Activity in Nude Mice," *Cancer Research* 53:2560-2565, Jun. 1, 1993. (7 pages).
Wong et al., "Suppression of IFN-β production by Epstein-Barr virus lytic transactivator Zta," *The Journal of Immunology* 198(1 Supplement):214.15, May 1, 2017. (2 pages).
Xie et al., "sgRNAcas9: A Software Package for Designing CRISPR sgRNA and Evaluating Potential Off-Target Cleavage Sites, "*PLoS ONE* 9(6):e100448, Jun. 23, 2014. (9 pages).
Yatim et al., "RIPK1 and NF-κB signaling in dying cells determines cross-priming of CD8+ T cells," *Science* 350(6258):328-334, Oct. 16, 2015. (8 pages).
Zhao et al., "Primary Human Lymphocytes Transduced with NY-ESO-1 Antigen-Specific TCR Genes Recognize and Kill Diverse Human Tumor Cell Lines," *The Journal of Immunology* 174:4415-4423, 2005.
Zhou et al., "Improving the Safety of T Cell Therapies using an Inducible Caspase-9 Gene," *Exp. Hematol.* 44(11):1013-1019, Nov. 2016. (14 pages).

\* cited by examiner

| Peptide \ TCR | 17 | 14 | 18 | 13 | 22 | 19 | 16 | 20 | 21 | 24 | 23 | 15 |
|---|---|---|---|---|---|---|---|---|---|---|---|---|
| G12D 10mer | +++ | - | - | +++ | +++ | - | +++ | - | +++ | + | - | - |
| G12D 9mer | - | - | - | + | - | - | - | - | - | - | - | - |
| G12V 10mer | - | - | - | - | - | + | - | +++ | - | + | +++ | +++ |
| G12V 9mer | - | +++ | - | - | - | +++ | - | - | - | - | - | - |
| WT | - | - | - | - | - | - | - | - | - | - | - | - |

*FIG. 4B*

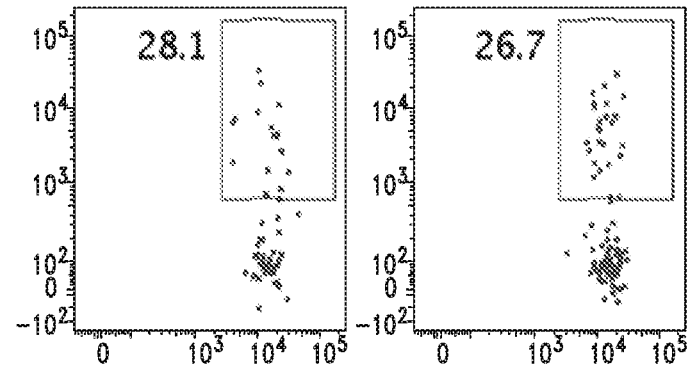
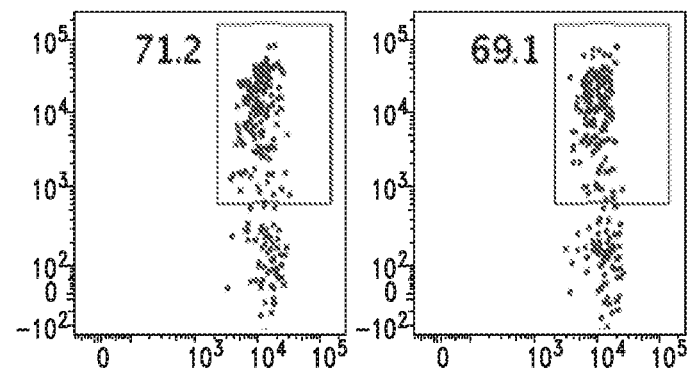
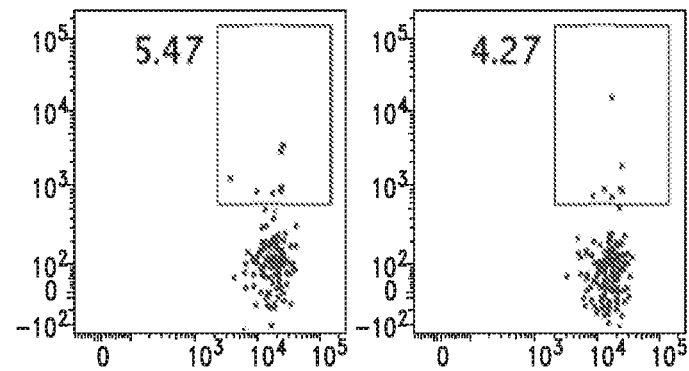
FIG. 6B

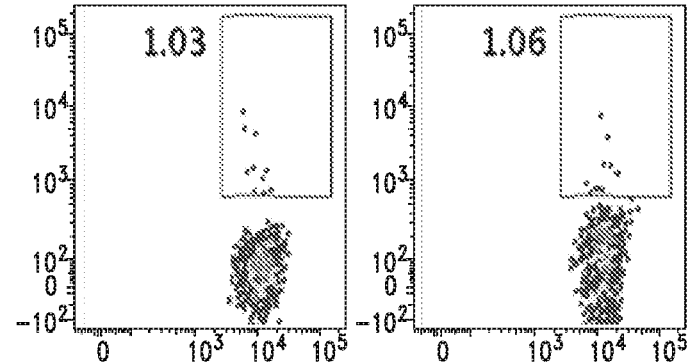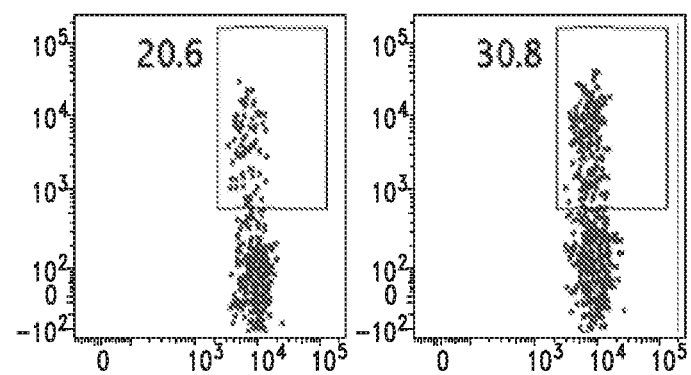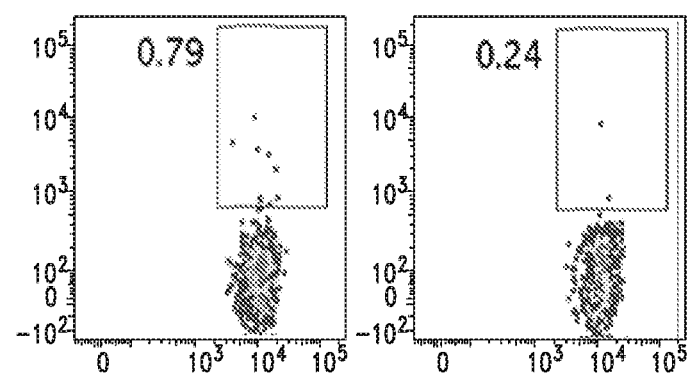
FIG. 6D

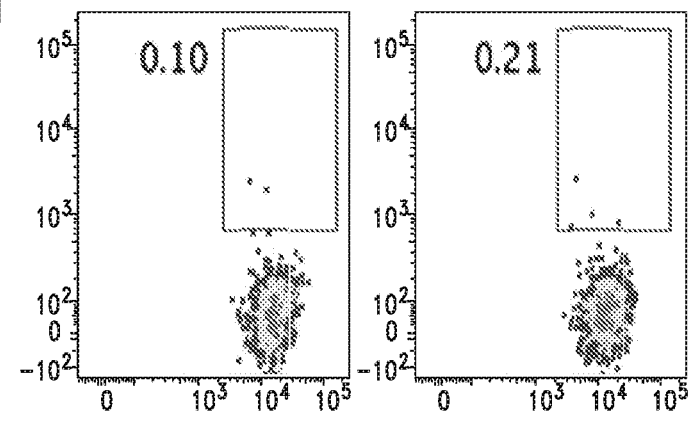
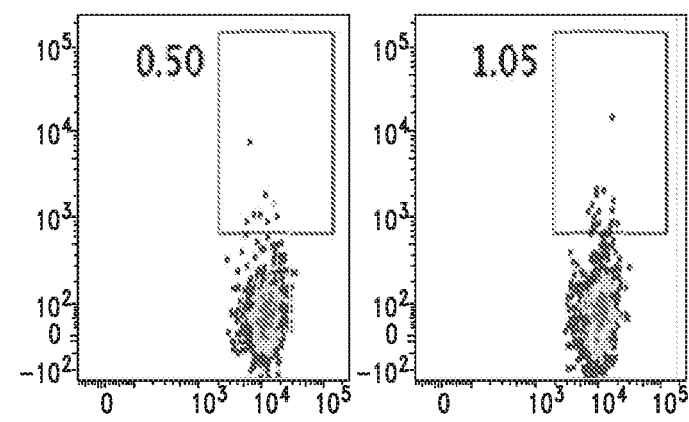
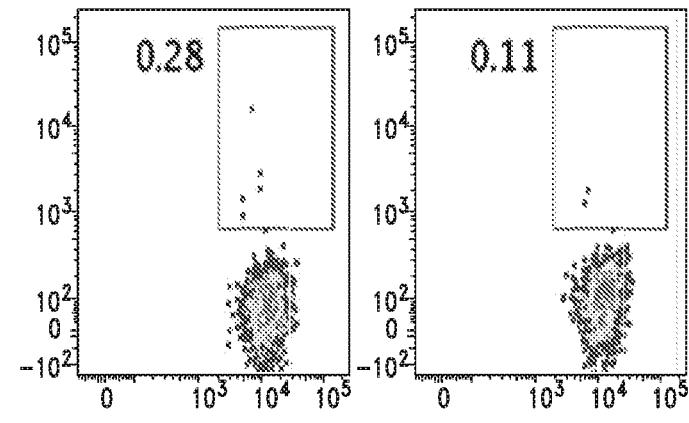
FIG. 6F

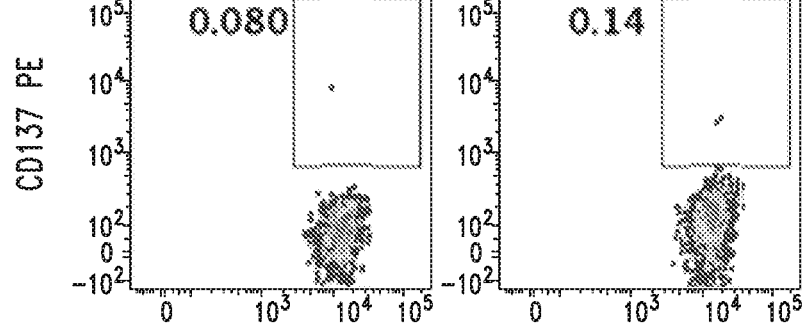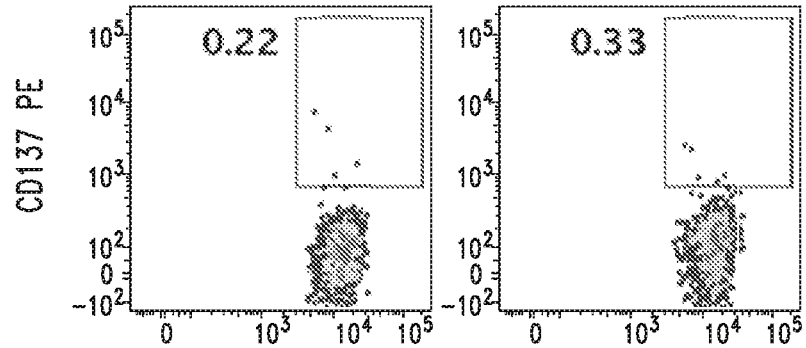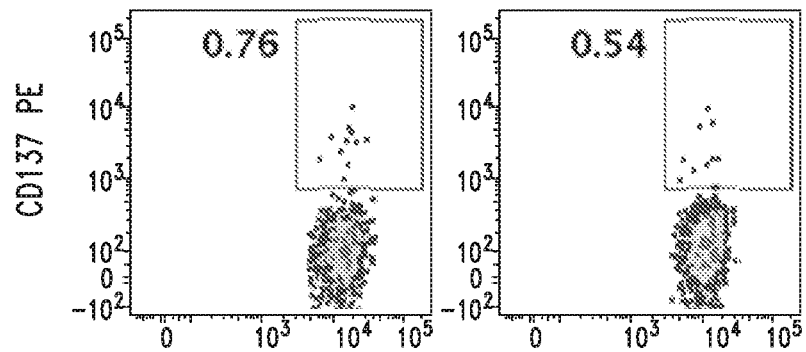
FIG. 7D

Predicted HLA-binding affinity of mutated KRAS G12D and KRAS G12V*

| Input sequence | allele | length | peptide | Binding affinity (nM) |
|---|---|---|---|---|
| KRAS G12V | HLA-A*03:01 | 10 | VVVGAVGVGK | 133 |
| | HLA-A*03:01 | 9 | VVGAVGVGK | 234 |

FIG. 9

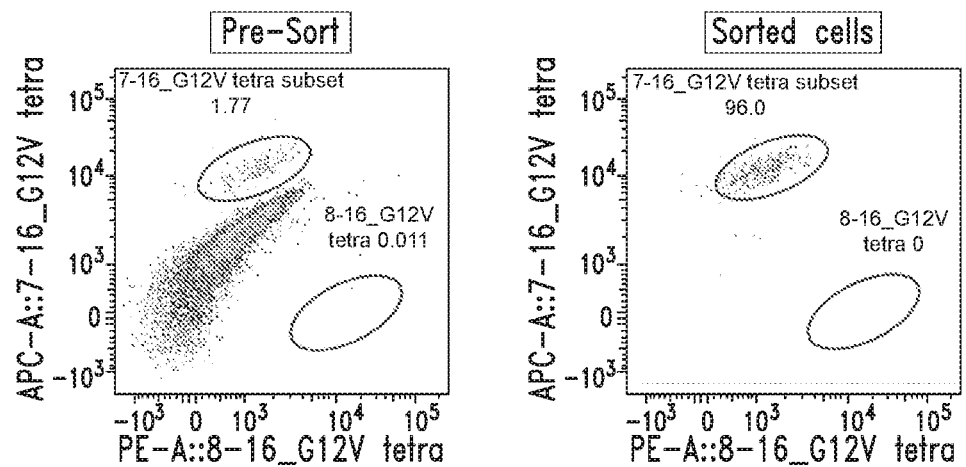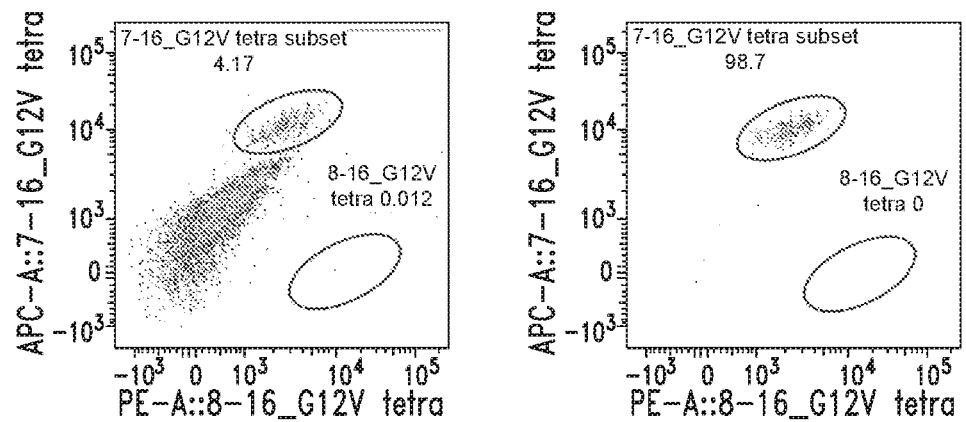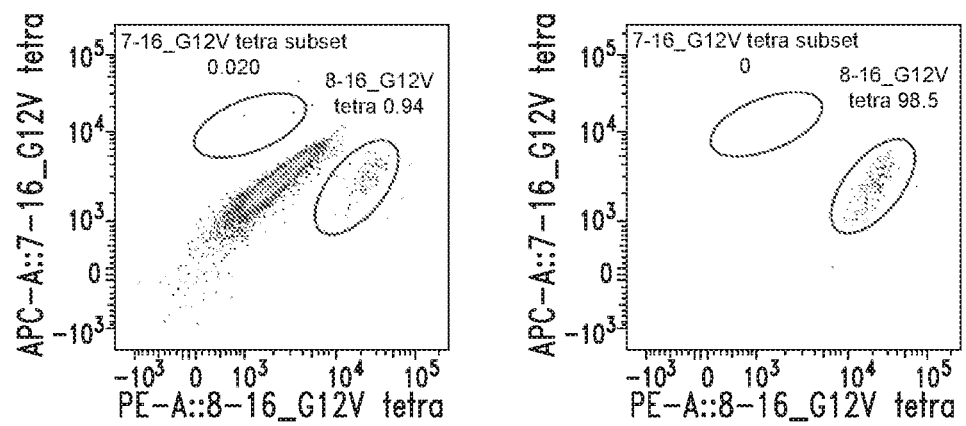
FIG. 11 (Continued)

| IEDB | | | | | | | | |
|---|---|---|---|---|---|---|---|---|
| Prediction method: IEDB recommended 2.19 | | | Low percentile_rank = good binders | | | | | |

G12D

| Allele | # | Start | End | Length | Peptide | Method used | Percentile rank | ANN IC50(nM) |
|---|---|---|---|---|---|---|---|---|
| HLA-A*02:01 | 1 | 5 | 14 | 10 | KLVVVGADGV | Consensus (ann/smm) | 3.2 | 498.01 |
| HLA-A*02:01 | 1 | 6 | 14 | 9 | LVVVGADGV | Consensus (ann/comblib) | 12 | 4317.54 |
| HLA-A*02:01 | 1 | 13 | 21 | 9 | GVGKSALTI | Consensus (ann/comblib) | 19 | 9439.78 |
| HLA-A*02:01 | 1 | 2 | 11 | 10 | TEYKLVVVGA | Consensus (ann/smm) | 26.5 | 16249.88 |

G12V

| Allele | # | Start | End | Length | Peptide | Method used | Percentile rank | ANN IC50(nM) |
|---|---|---|---|---|---|---|---|---|
| HLA-A*02:01 | 1 | 5 | 14 | 10 | KLVVVGAVGV | Consensus (ann/smm) | 2.05 | 300.18 |
| HLA-A*02:01 | 1 | 6 | 14 | 9 | LVVVGAVGV | Consensus (ann/comblib) | 6.3 | 1710.31 |
| HLA-A*02:01 | 1 | 4 | 12 | 9 | YKLVVVGAV | Consensus (ann/comblib) | 13 | 4918.47 |
| HLA-A*02:01 | 1 | 13 | 21 | 9 | GVGKSALTI | Consensus (ann/comblib) | 19 | 9439.78 |
| HLA-A*02:01 | 1 | 5 | 13 | 9 | KLVVVGAVG | Consensus (ann/comblib) | 23 | 9675.66 |
| HLA-A*02:01 | 1 | 4 | 13 | 10 | YKLVVVGAVG | Consensus (ann/smm) | 25 | 7625.04 |

*FIG. 12*

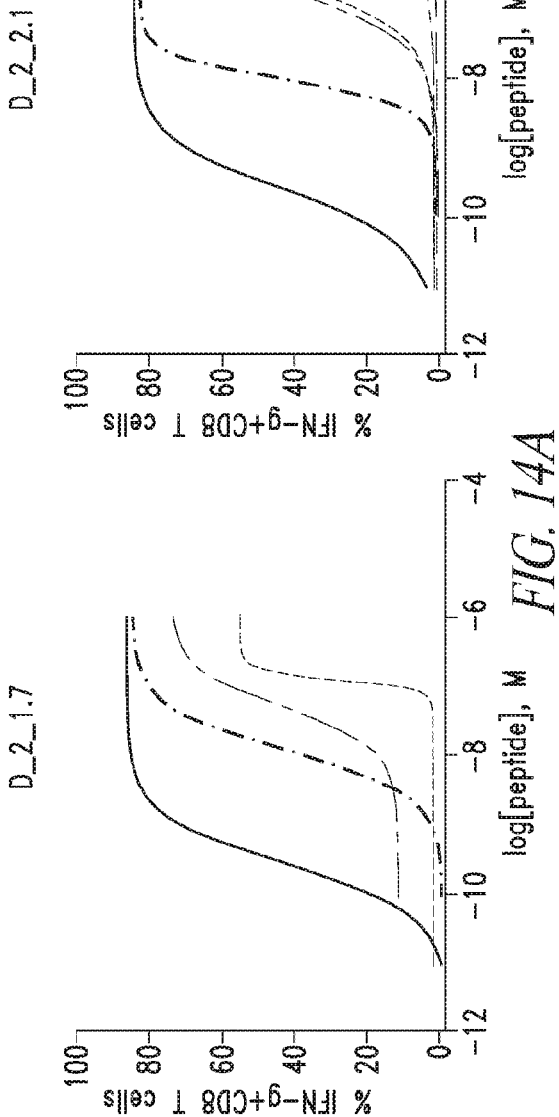
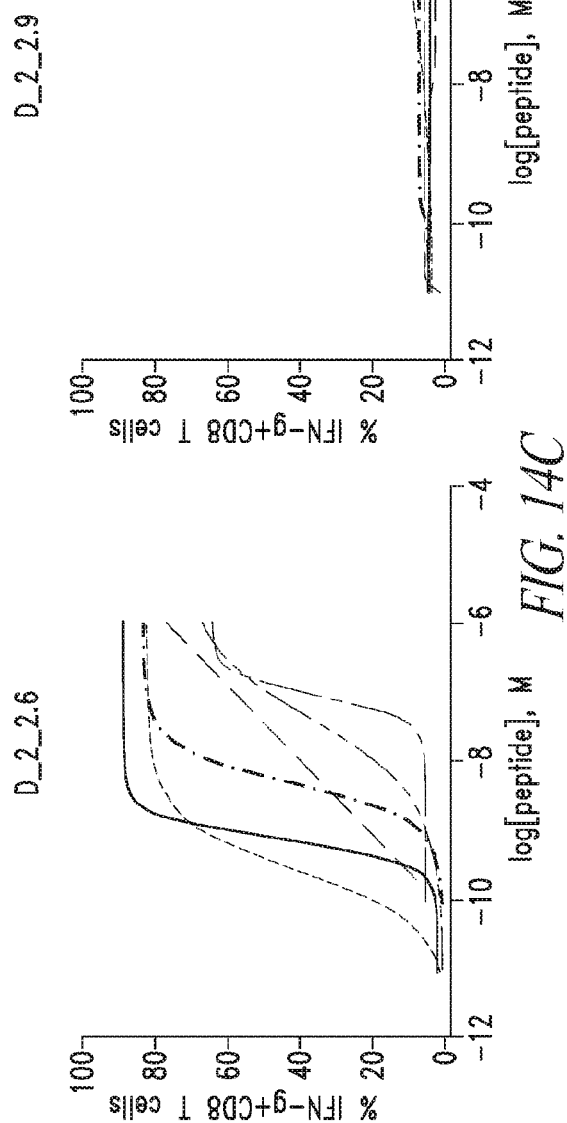
FIG. 14A  FIG. 14B  FIG. 14C  FIG. 14D

| PLATE 1 | 10,000 ng/ml | 1,000 ng/ml | 100 ng/ml | 10 ng/ml |
|---|---|---|---|---|
| TCR-1 | 26.6 | 29.2 | 29.6 | 23.8 |
| TCR-2 | 37.7 | 37.5 | 32.5 | 31.3 |
| TCR-3 | 29 | 27.9 | 24.8 | 24.7 |
| TCR-4 | 23.8 | 25.1 | 18 | 17.1 |
| TCR-5 | 31.2 | 25.9 | 25.2 | 16.8 |
| TCR-6 | 33.1 | 25.2 | 26.8 | 15.7 |
| TCR-7 | 33.8 | 27.9 | 31.4 | 24.3 |
| TCR-18 | 38.7 | 37.7 | 32.1 | 17.3 |
| PLATE 2 | 10,000 ng/ml | 1,000 ng/ml | 100 ng/ml | 10 ng/ml |
| TCR-9 | 46.5 | 41.8 | 38.7 | 24.2 |
| TCR-10 | 41.5 | 36.4 | 34.9 | 20.6 |
| TCR-11 | 40.6 | 38.8 | 35.3 | 26 |
| TCR-12 | 36.7 | 35.4 | 29.4 | 12.9 |
| TCR-13 | 35 | 36.1 | 32.7 | 28 |
| TCR-14 | 38.5 | 35 | 32.7 | 23.8 |
| TCR-16 | 34.4 | 28.2 | 20 | 5.5 |
| TCR-17 | 33.3 | 33.3 | 31.5 | 21.2 |
| PLATE 3 | 10,000 ng/ml | 1,000 ng/ml | 100 ng/ml | 10 ng/ml |
| TCR-18 | 31.8 | 33.9 | 28.6 | 10.8 |
| TCR-19 | 36 | 38.3 | 38.6 | 30.8 |
| WT-1 | 0.072 | 0.15 | 0.11 | 0.19 |
| Untransduced | 0.069 | 0.036 | 0.034 | 0 |

*FIG. 17*

| PLATE 1 | 1 ng/ml | 0.1 ng/ml | 0.01 ng/ml | No peptide | WT KRAS (10,000 ng/ml) |
|---|---|---|---|---|---|
| TCR-1 | 12 | 0.56 | 0 | 0.035 | 0.92 |
| TCR-2 | 18.4 | 0.61 | 0 | 0 | 0.41 |
| TCR-3 | 16.1 | 1.12 | 0 | 0 | 3.87 |
| TCR-4 | 2.79 | 0.13 | 0 | 0.044 | 0 |
| TCR-5 | 2.21 | 0.047 | 0 | 0 | 0.048 |
| TCR-6 | 9.13 | 0.63 | 0 | 0 | 0 |
| TCR-7 | 14.3 | 0.42 | 0 | 0.04 | 0.29 |
| TCR-18 | 0.42 | 0.043 | 0 | 0 | 0 |
| PLATE 2 | 1 ng/ml | 0.1 ng/ml | 0.01 ng/ml | No peptide | WT KRAS (10,000 ng/ml) |
| TCR-9 | 17 | 0.25 | 0 | 0 | 0.4 |
| TCR-10 | 8.72 | 0.082 | 0 | 0 | 1.46 |
| TCR-11 | 12.7 | 0.044 | 0 | 0 | 0.16 |
| TCR-12 | 2.73 | 0 | 0 | 0.091 | 31.3 |
| TCR-13 | 15 | 0.71 | 0 | 0 | 0.37 |
| TCR-14 | 11.7 | 0.01 | 0 | 0 | 0.16 |
| TCR-16 | 0.84 | 0 | 0.048 | 0 | 0 |
| TCR-17 | 15.2 | 0.67 | 0.087 | 0 | 0.4 |
| PLATE 3 | 1 ng/ml | 0.1 ng/ml | 0.01 ng/ml | No peptide | WT KRAS (10,000 ng/ml) |
| TCR-18 | 0.1 | 0 | 0 | 0 | 0 |
| TCR-19 | 23.9 | 5.5 | 0.12 | 0 | 3.79 |
| WT-1 | 0.19 | 0 | 0 | 0 | 0 |
| Untransduced | 0 | 0.067 | 0 | 0.034 | 0 |

*FIG. 17  (Continued)*

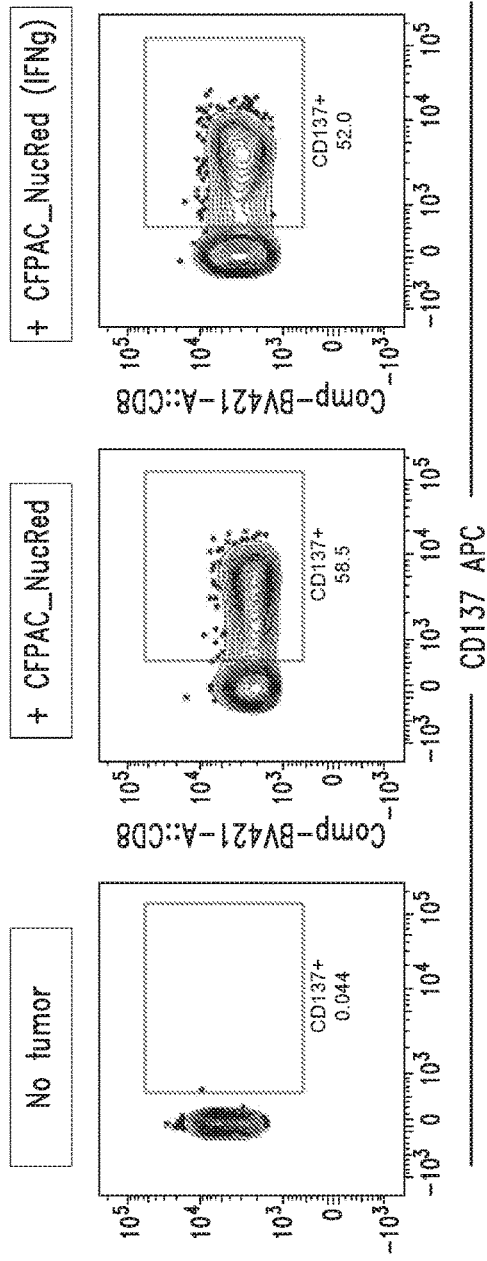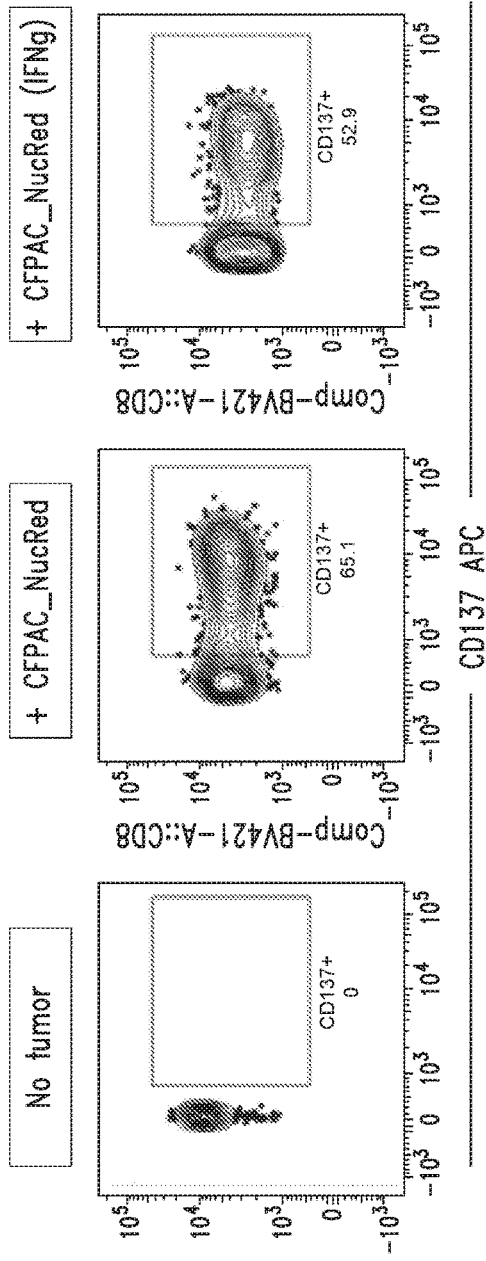
FIG. 19 (Continued)

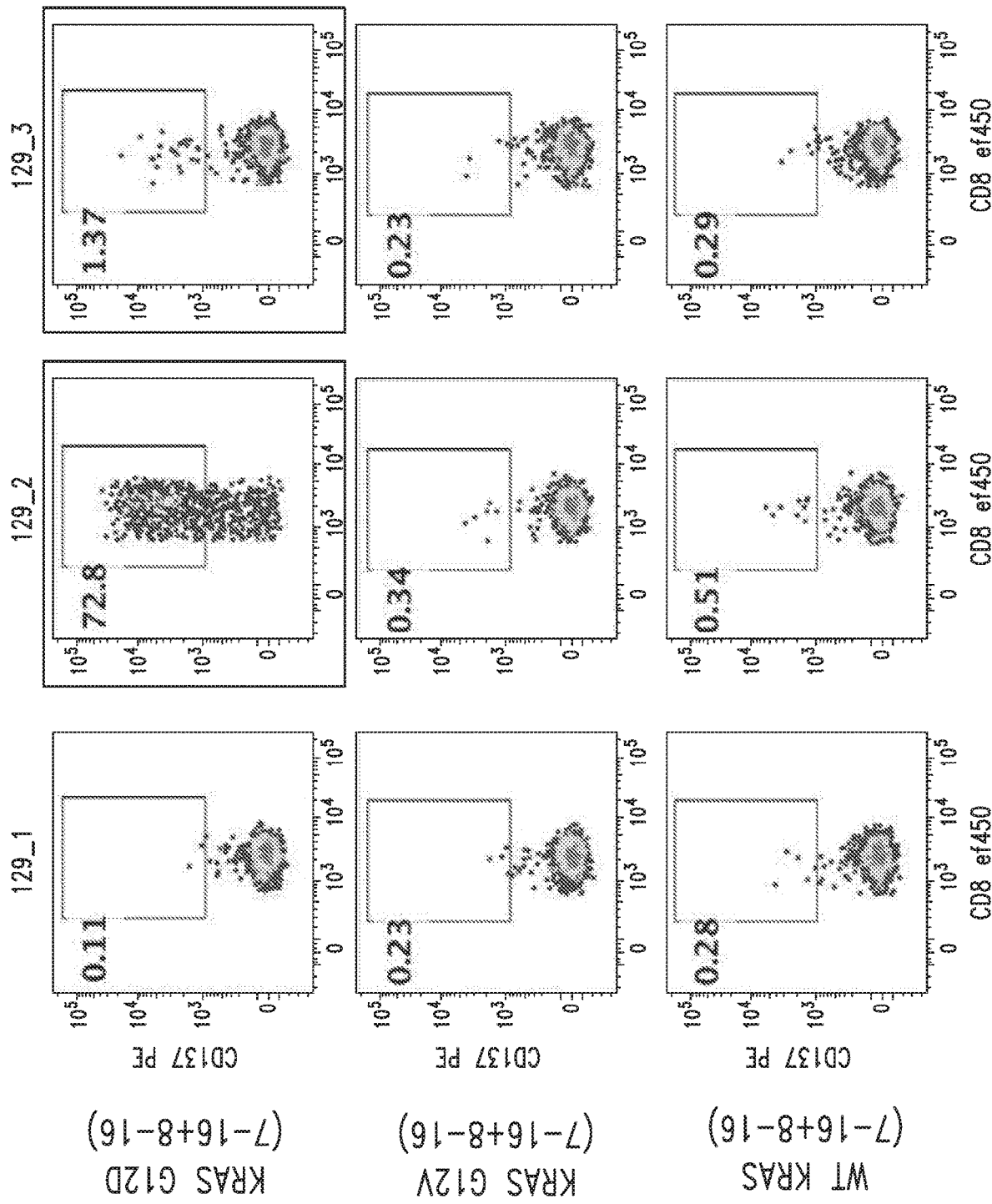

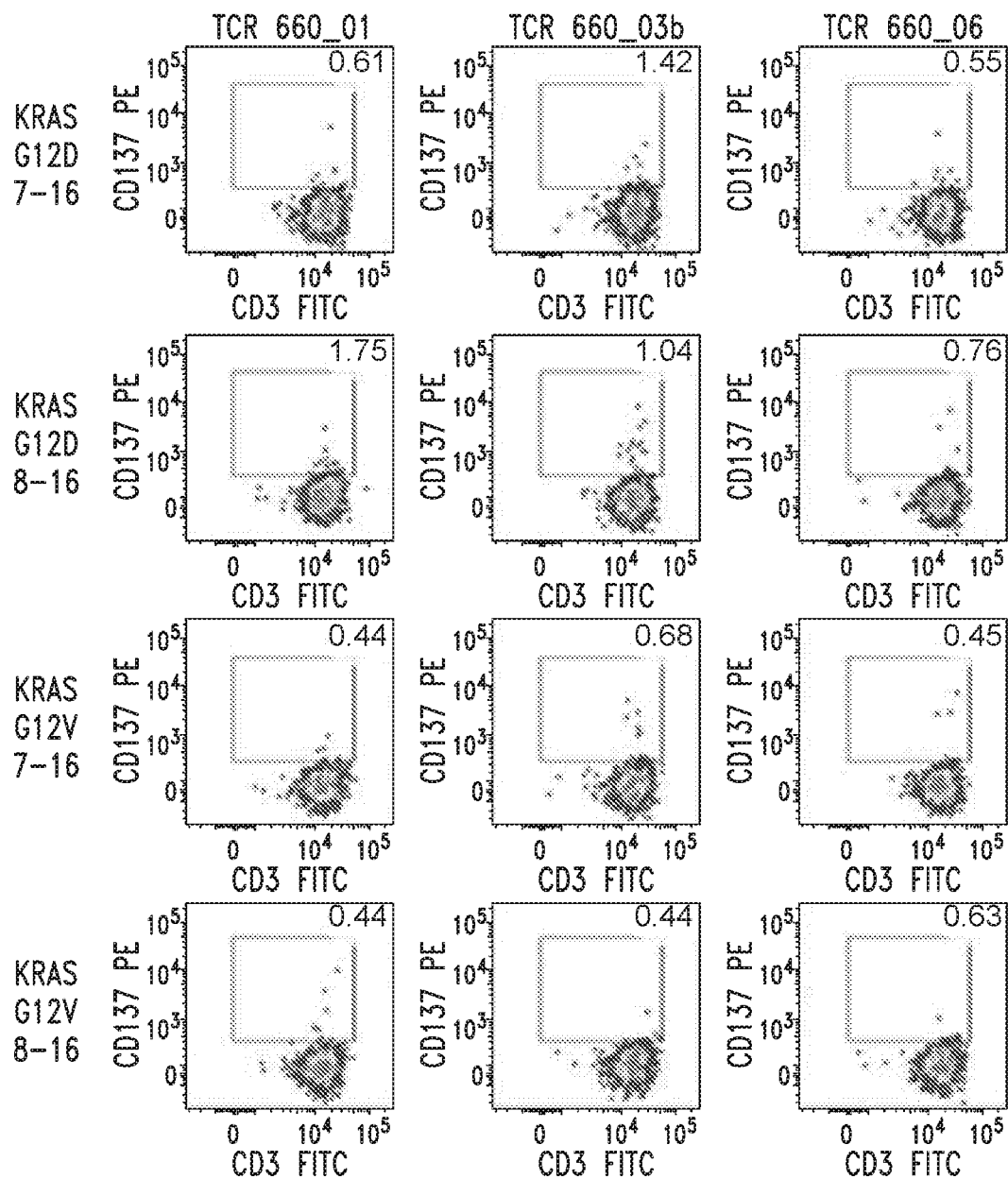
FIG. 28A (1)

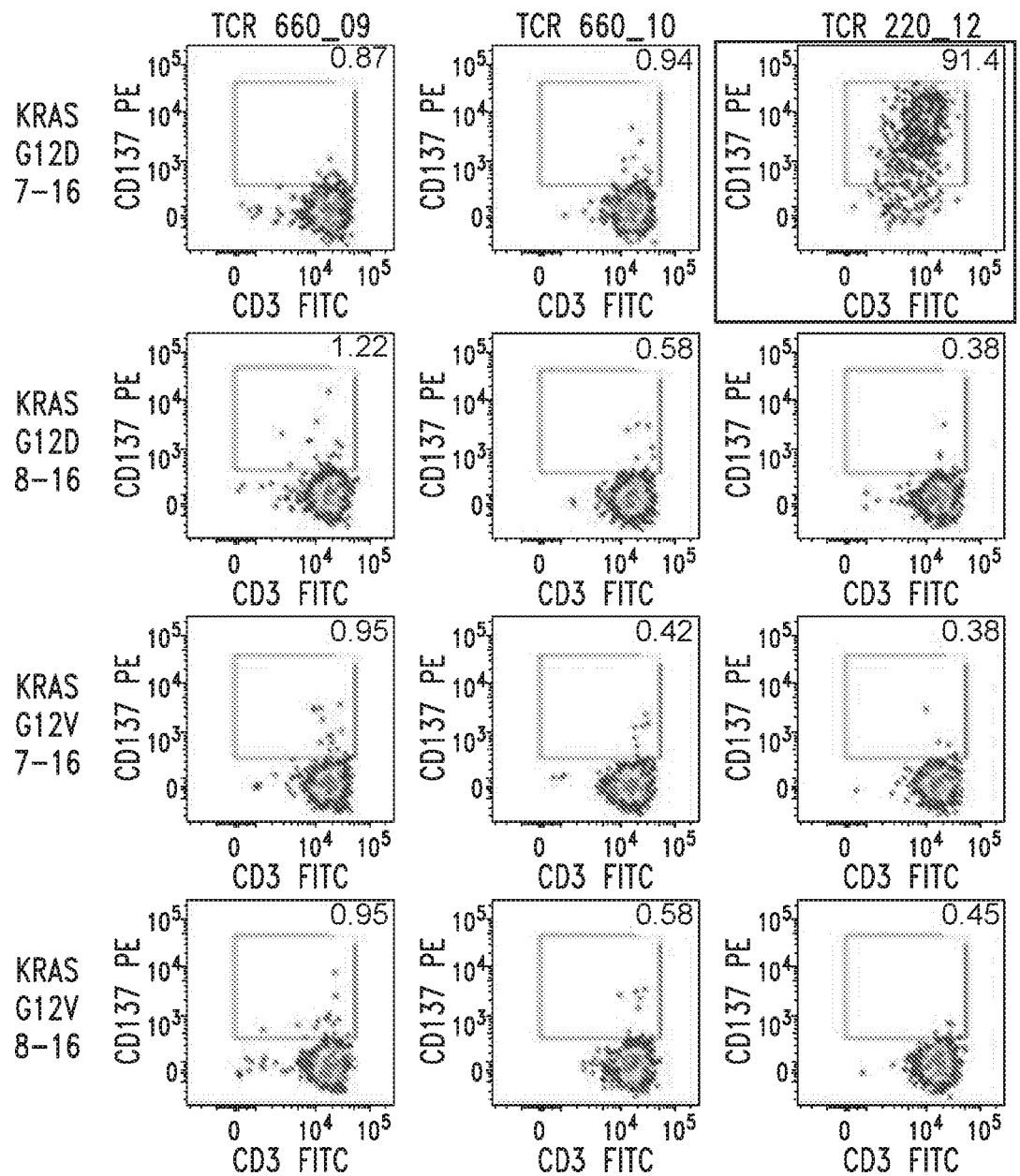
FIG. 28A (2)

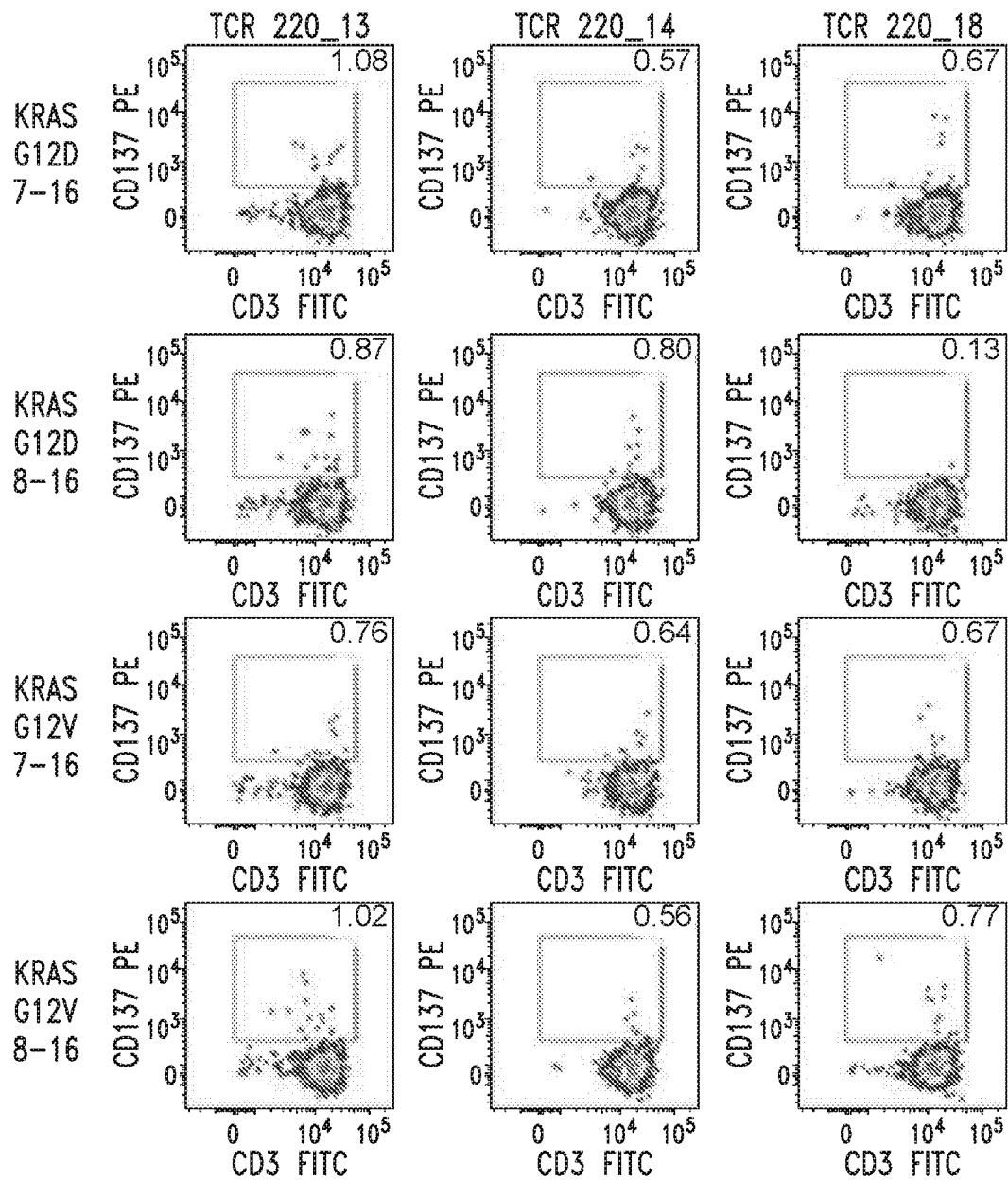
FIG. 28A (3)

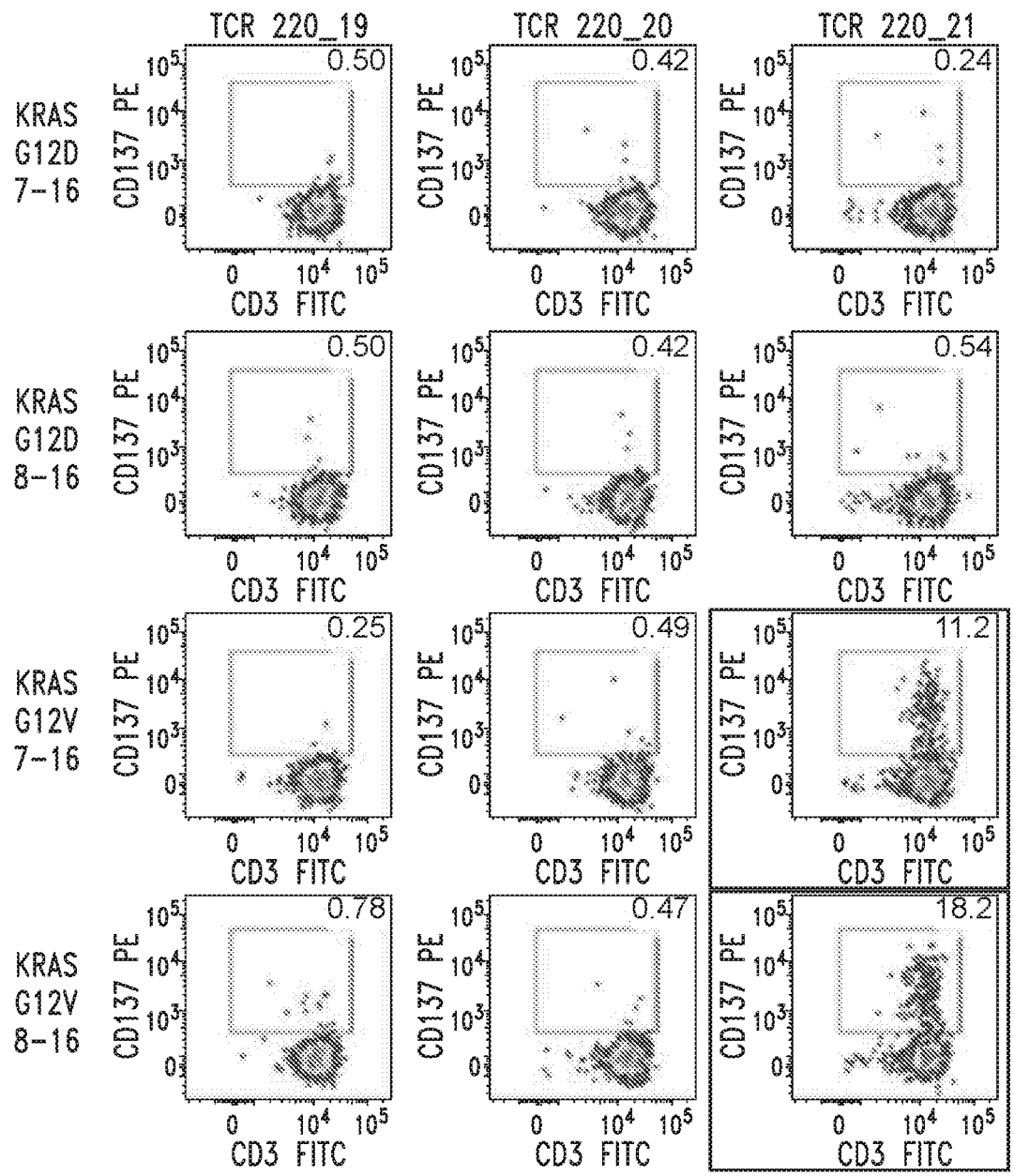
FIG. 28A (4)

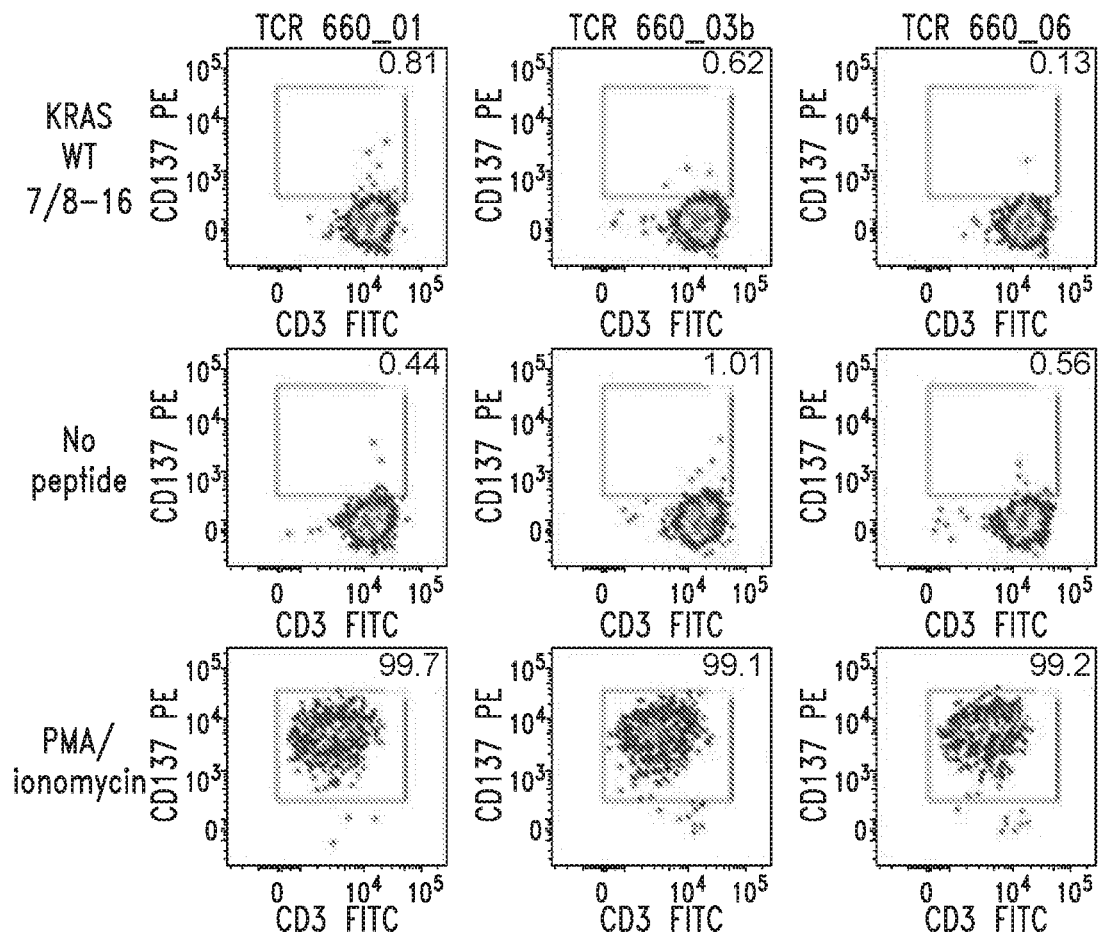
FIG. 28A (5)

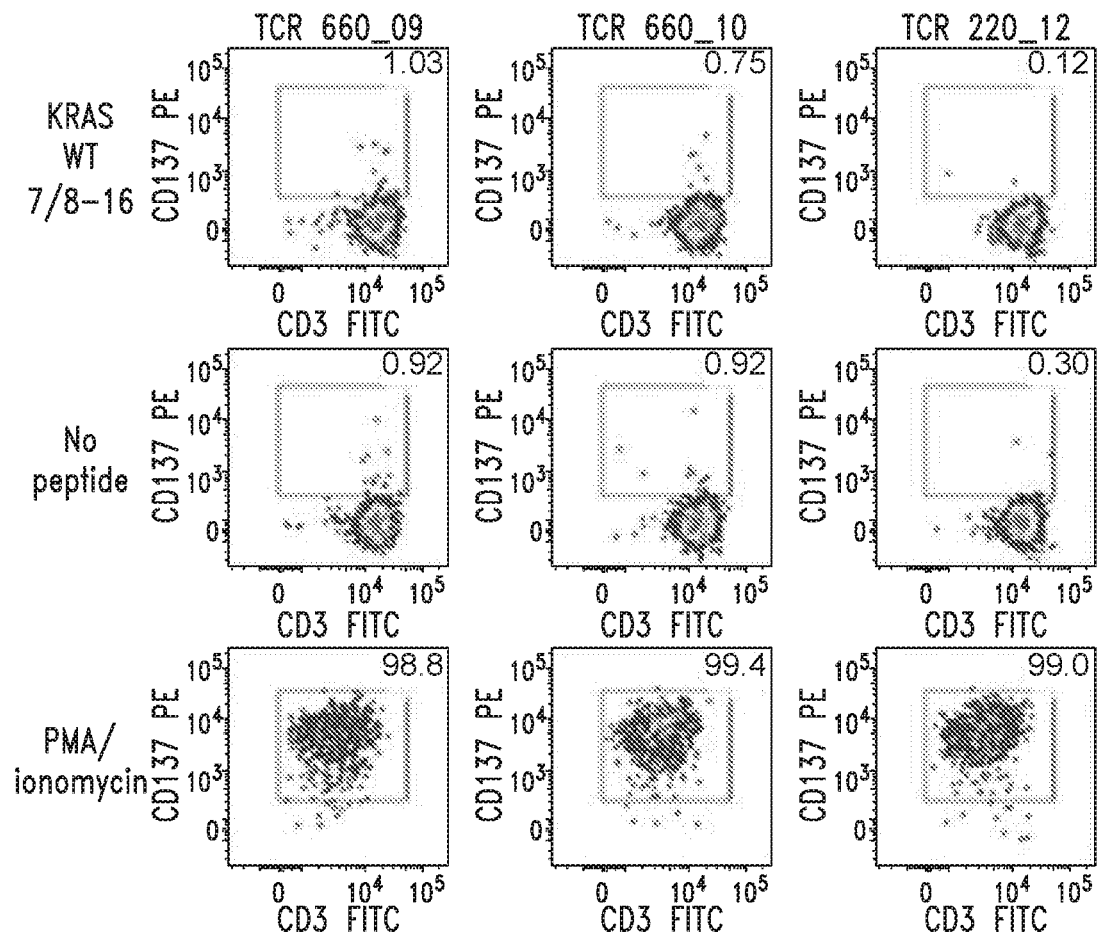
FIG. 28A (6)

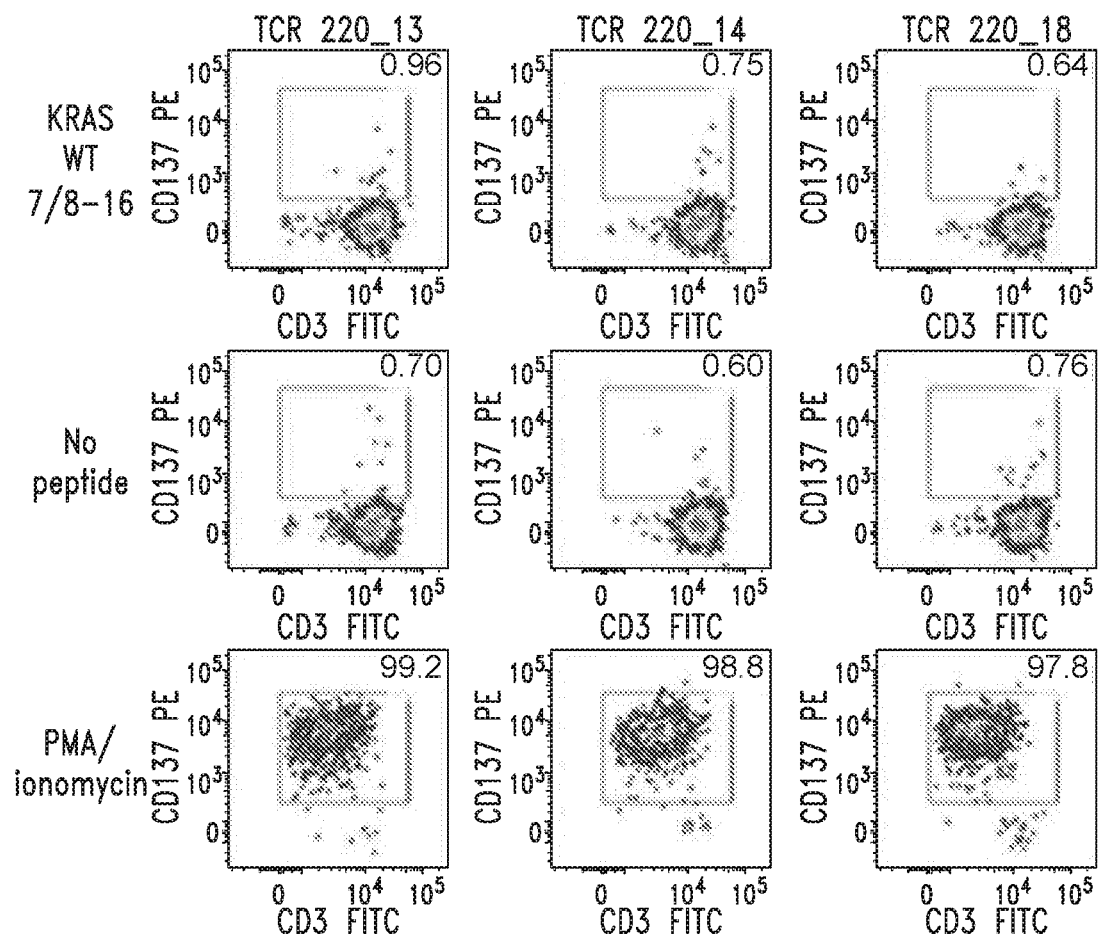
FIG. 28A (7)

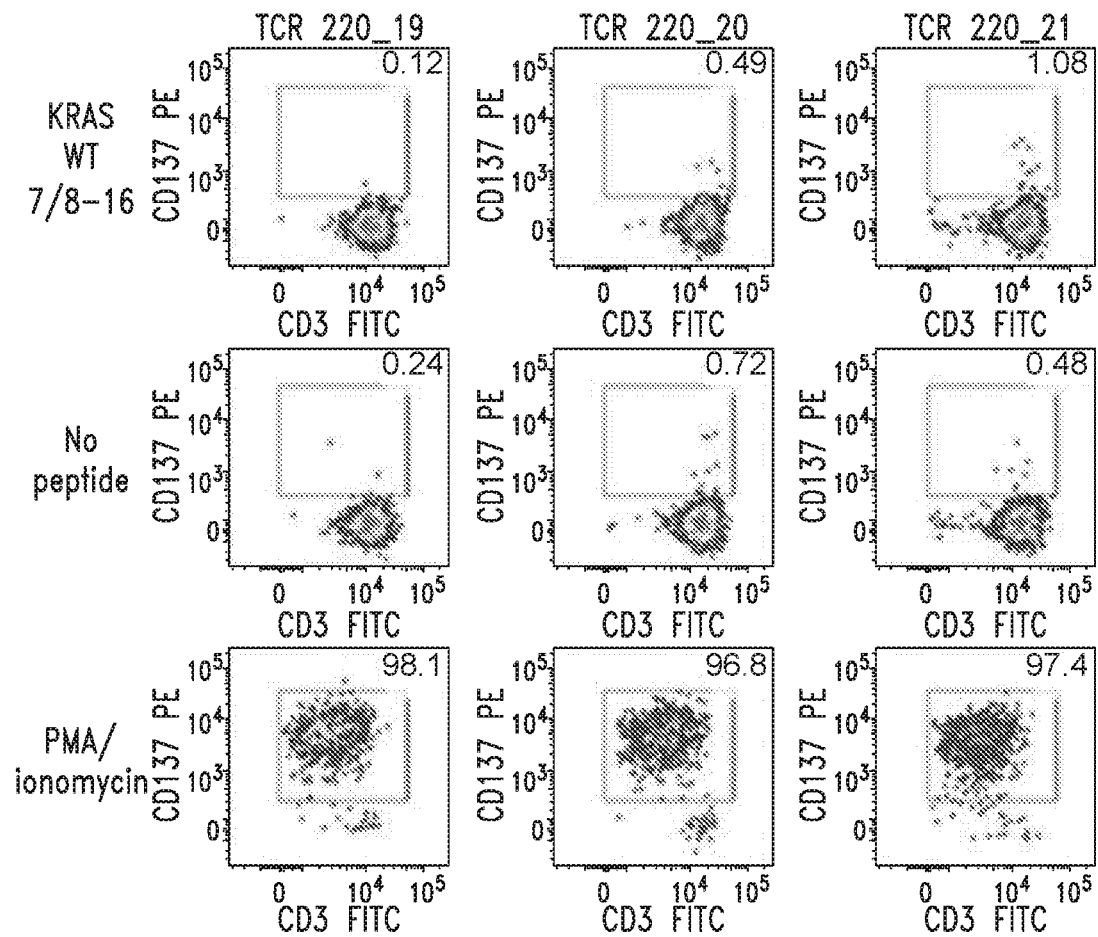
FIG. 28A (8)

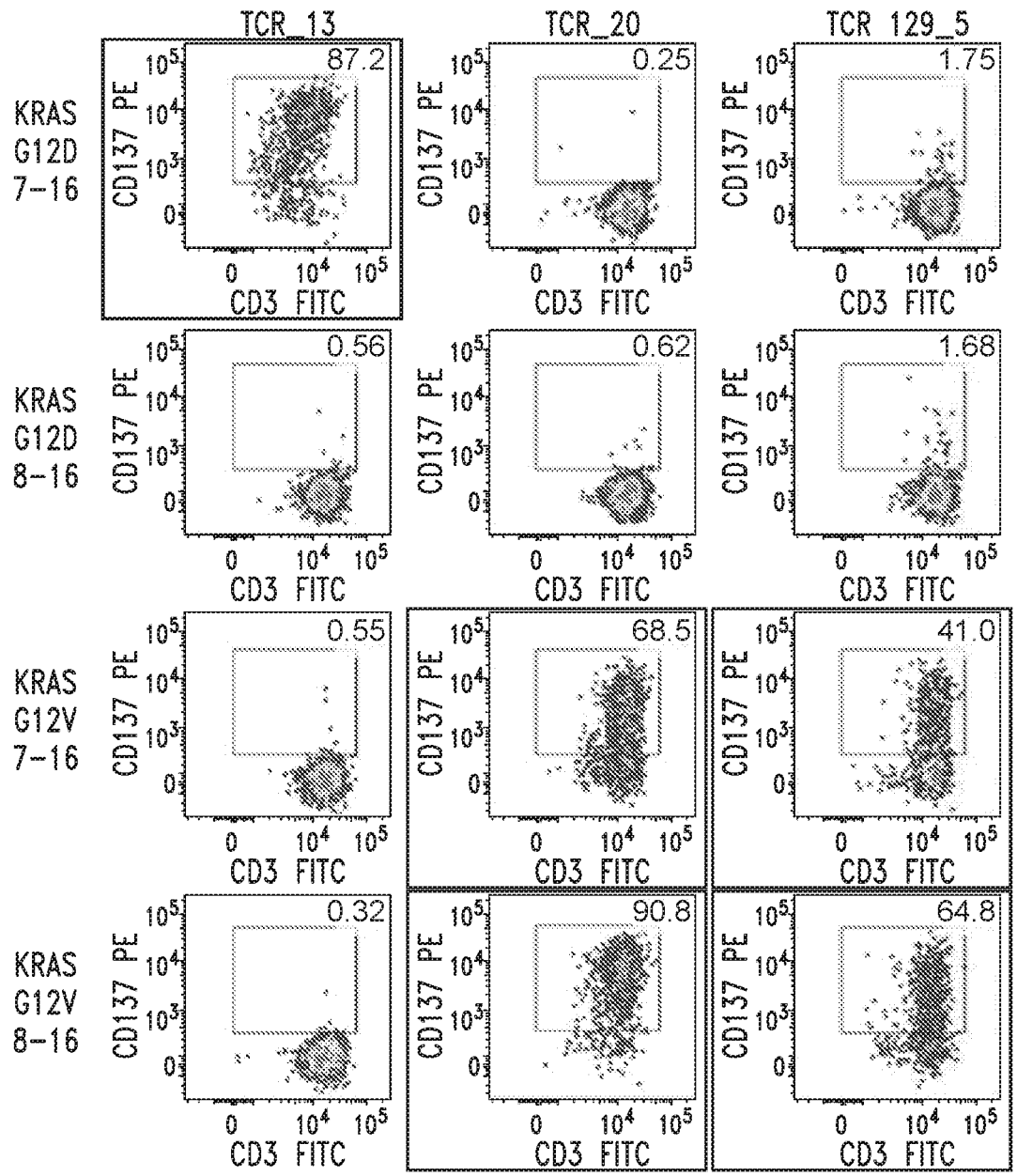
FIG. 28B (1)

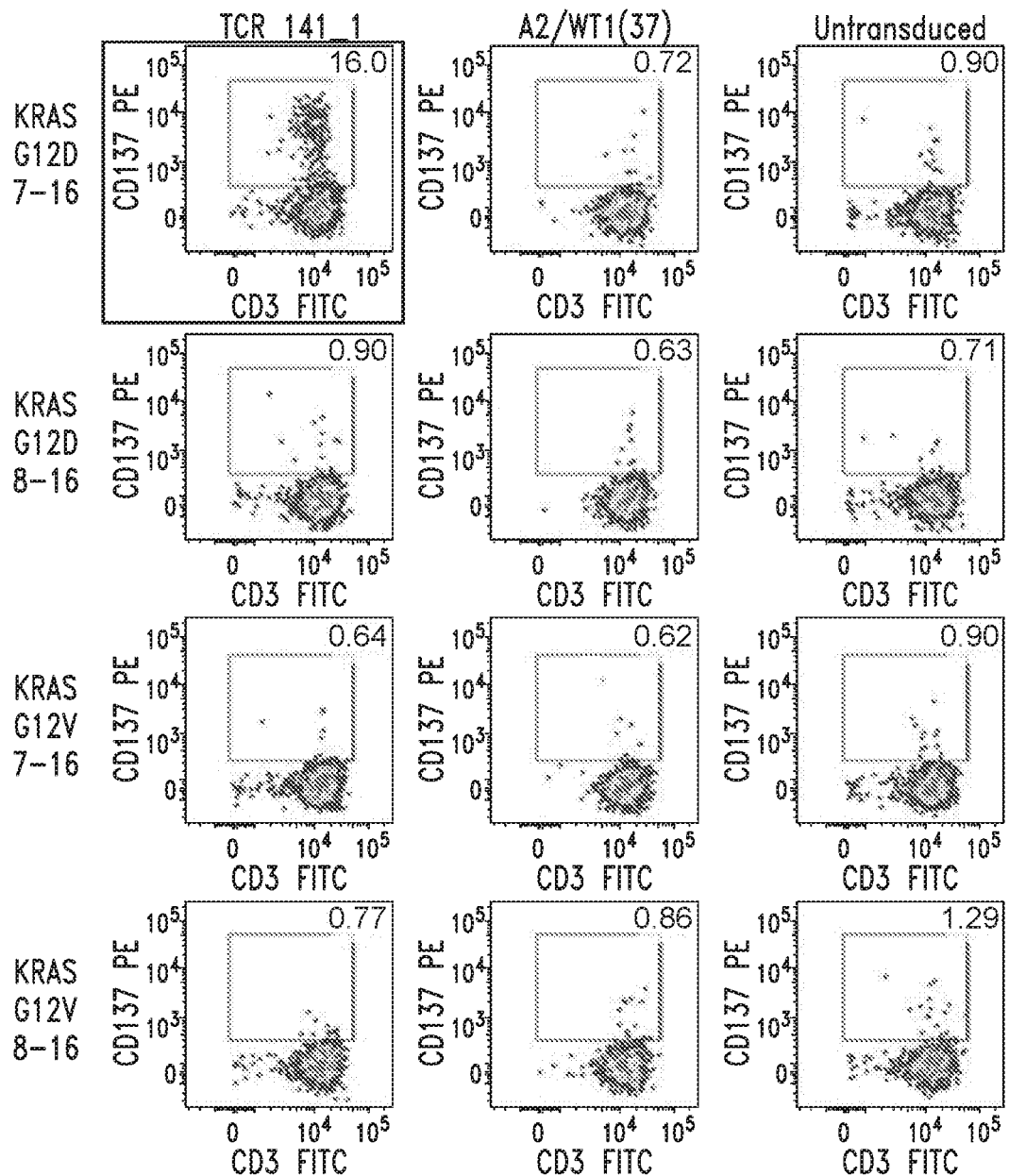
FIG. 28B (2)

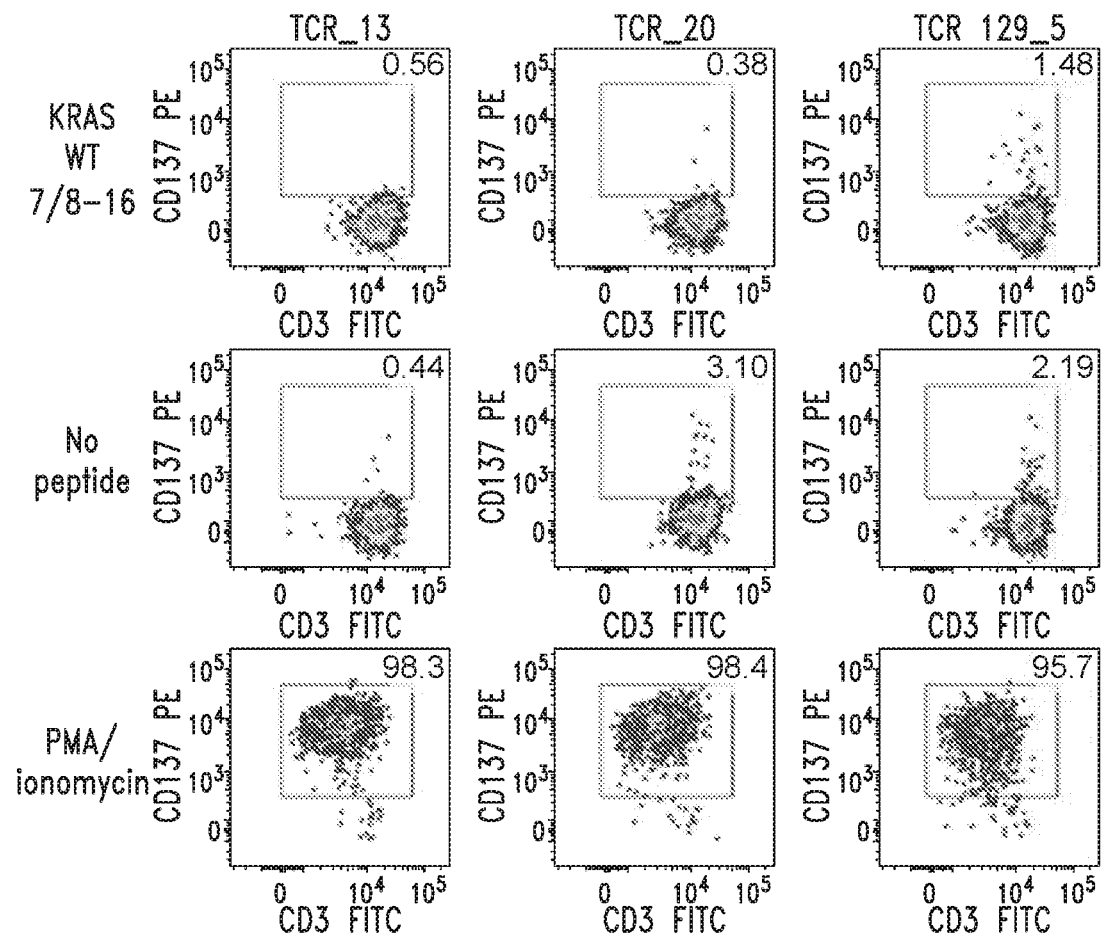
FIG. 28B (3)

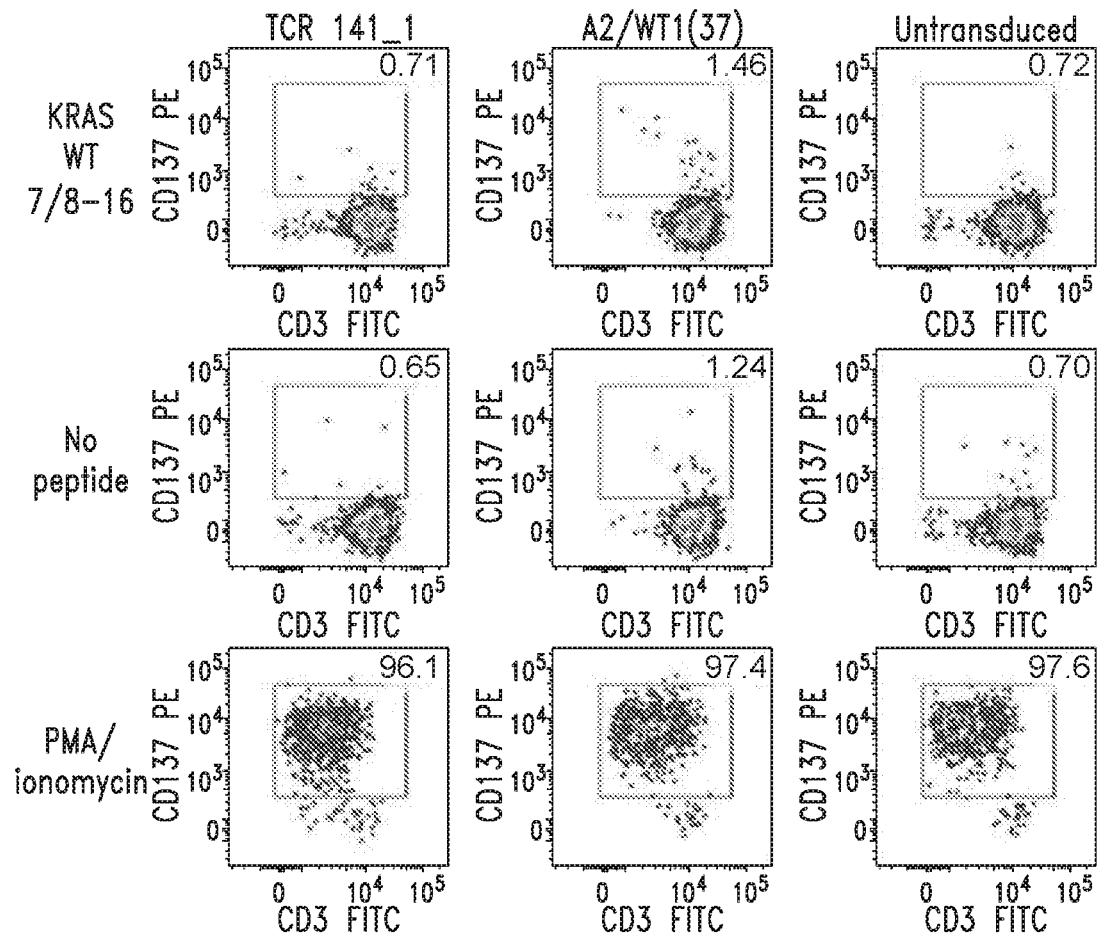
FIG. 28B (4)

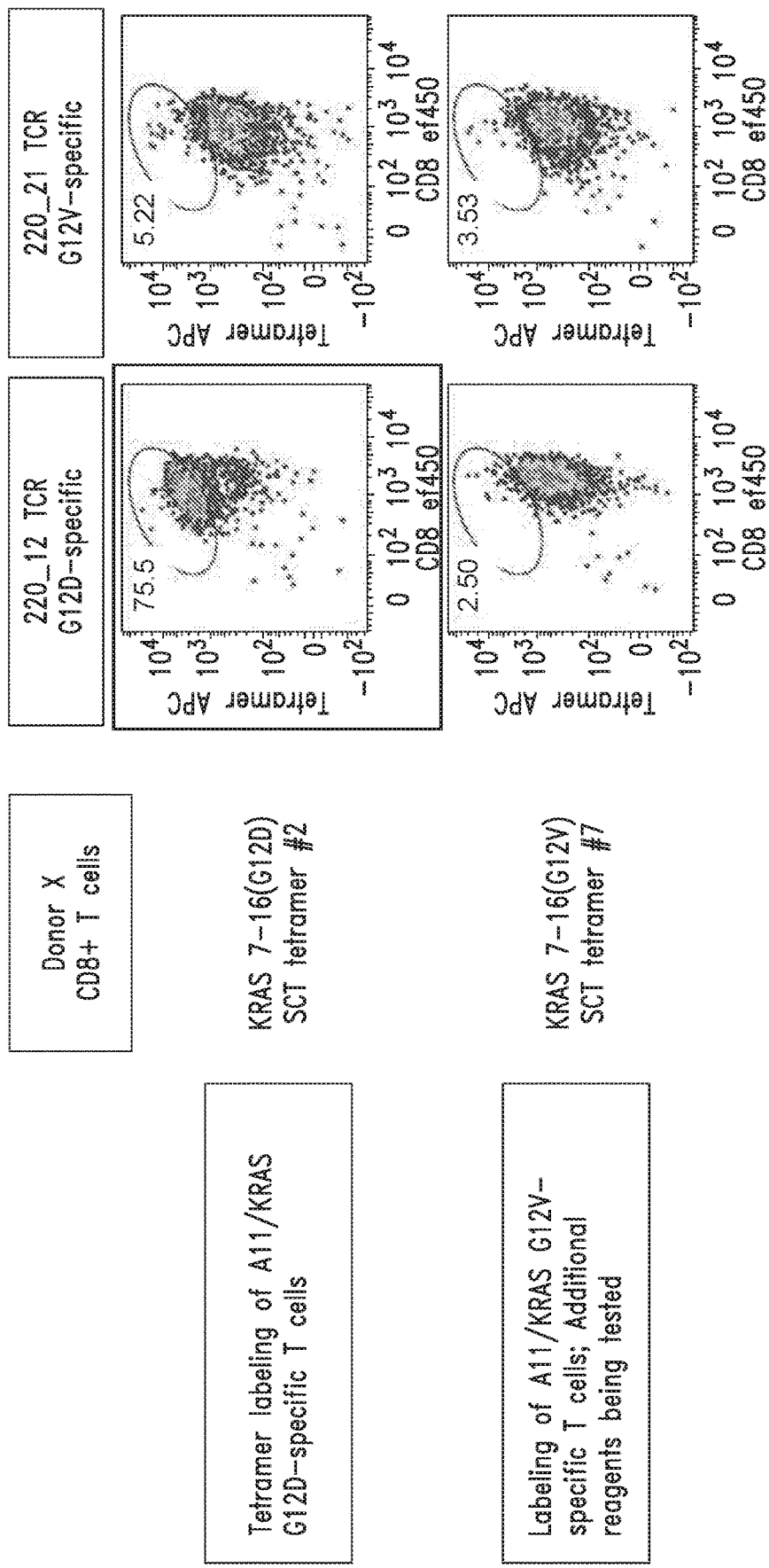
FIG. 31A(1)

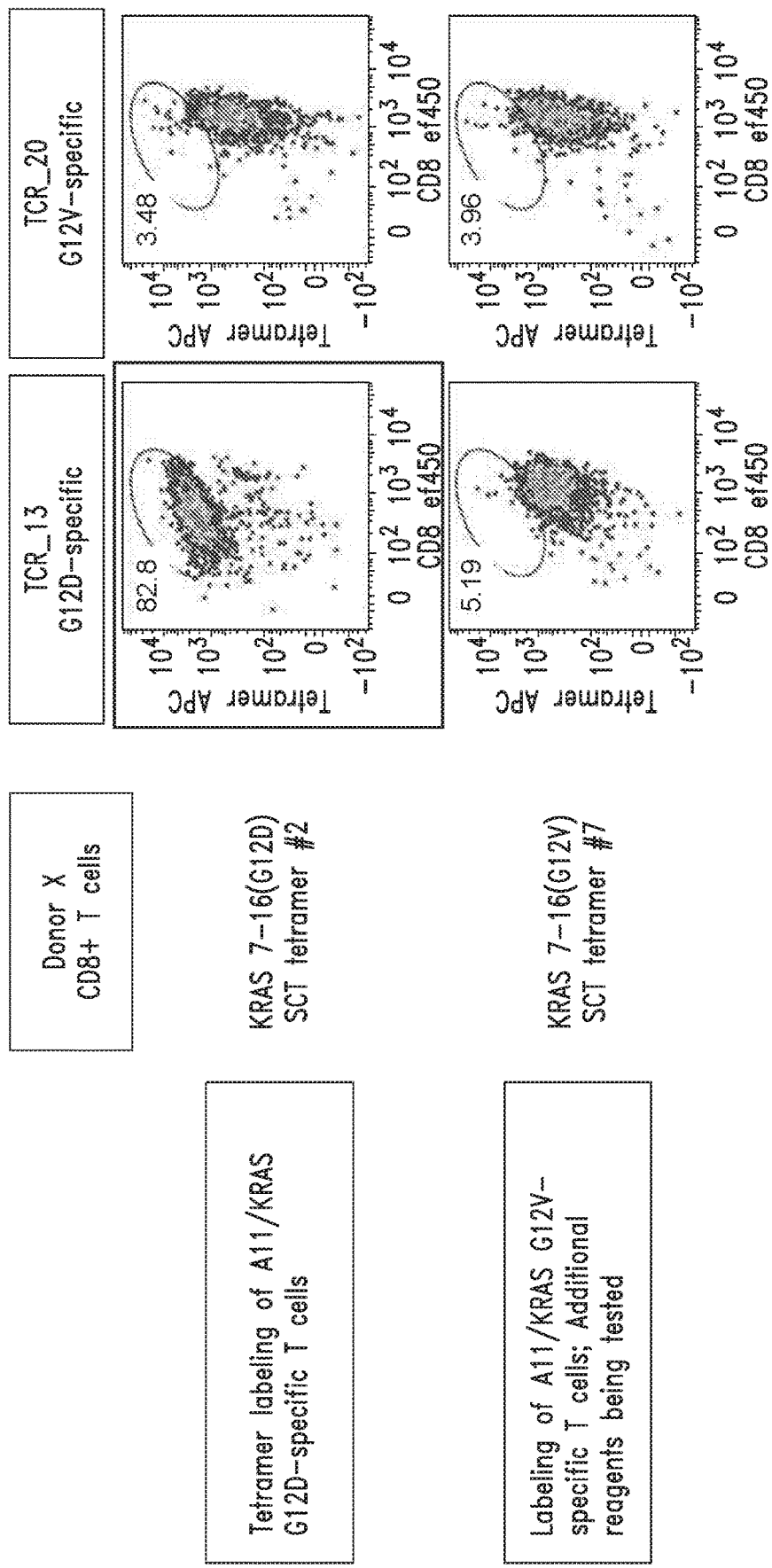
FIG. 31A (2)

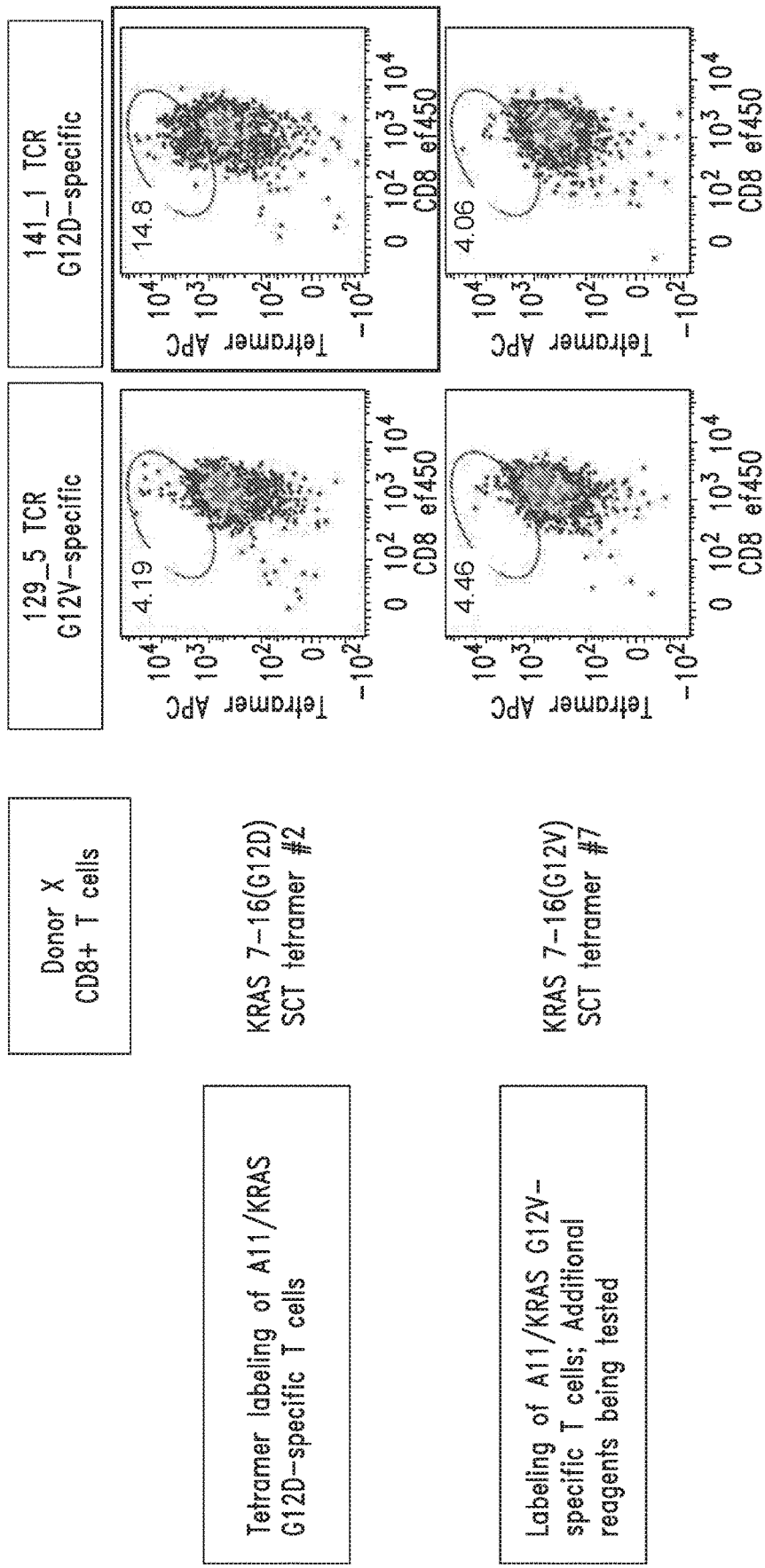
FIG. 31A (3)

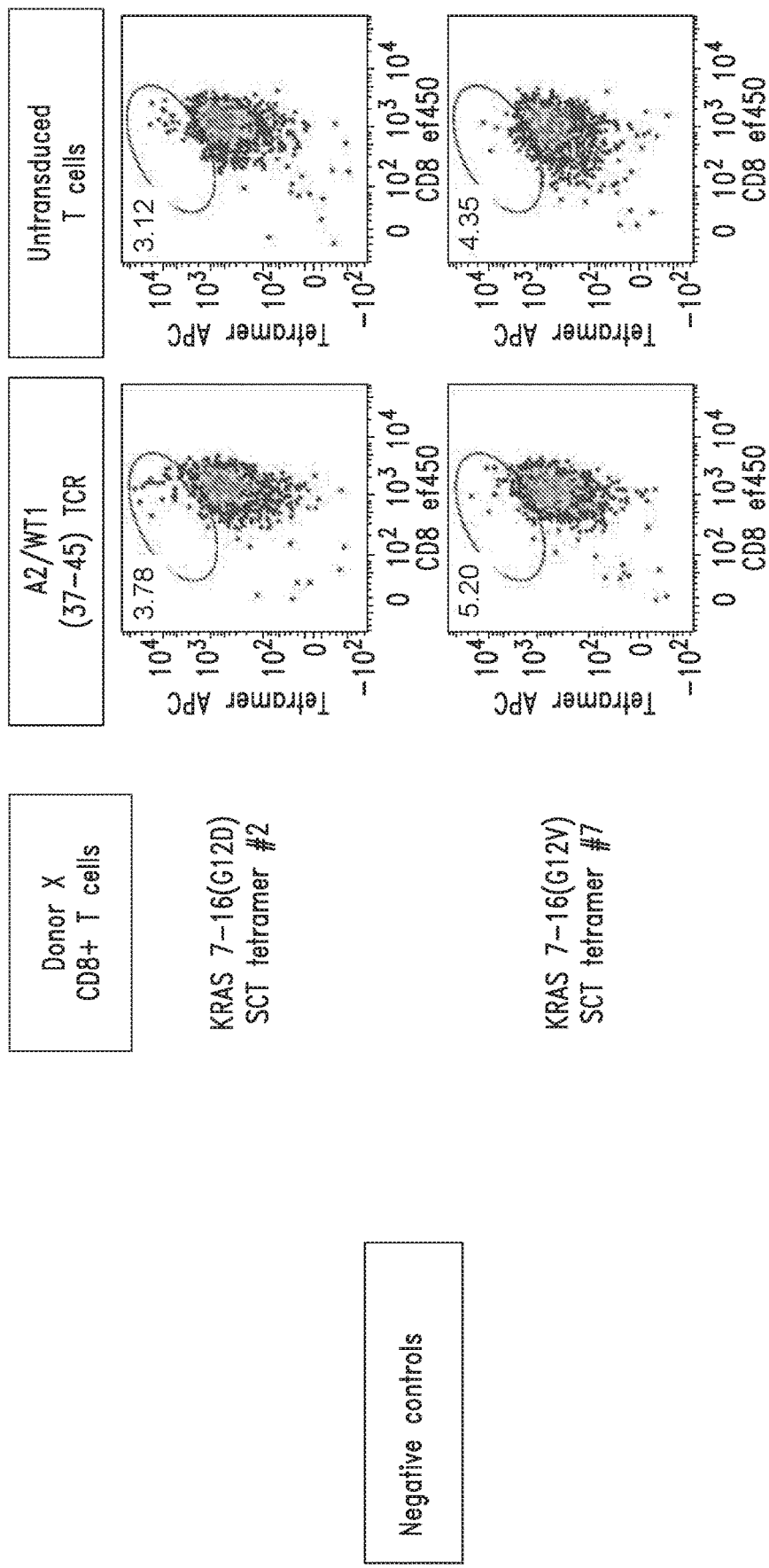
FIG. 31A (4)

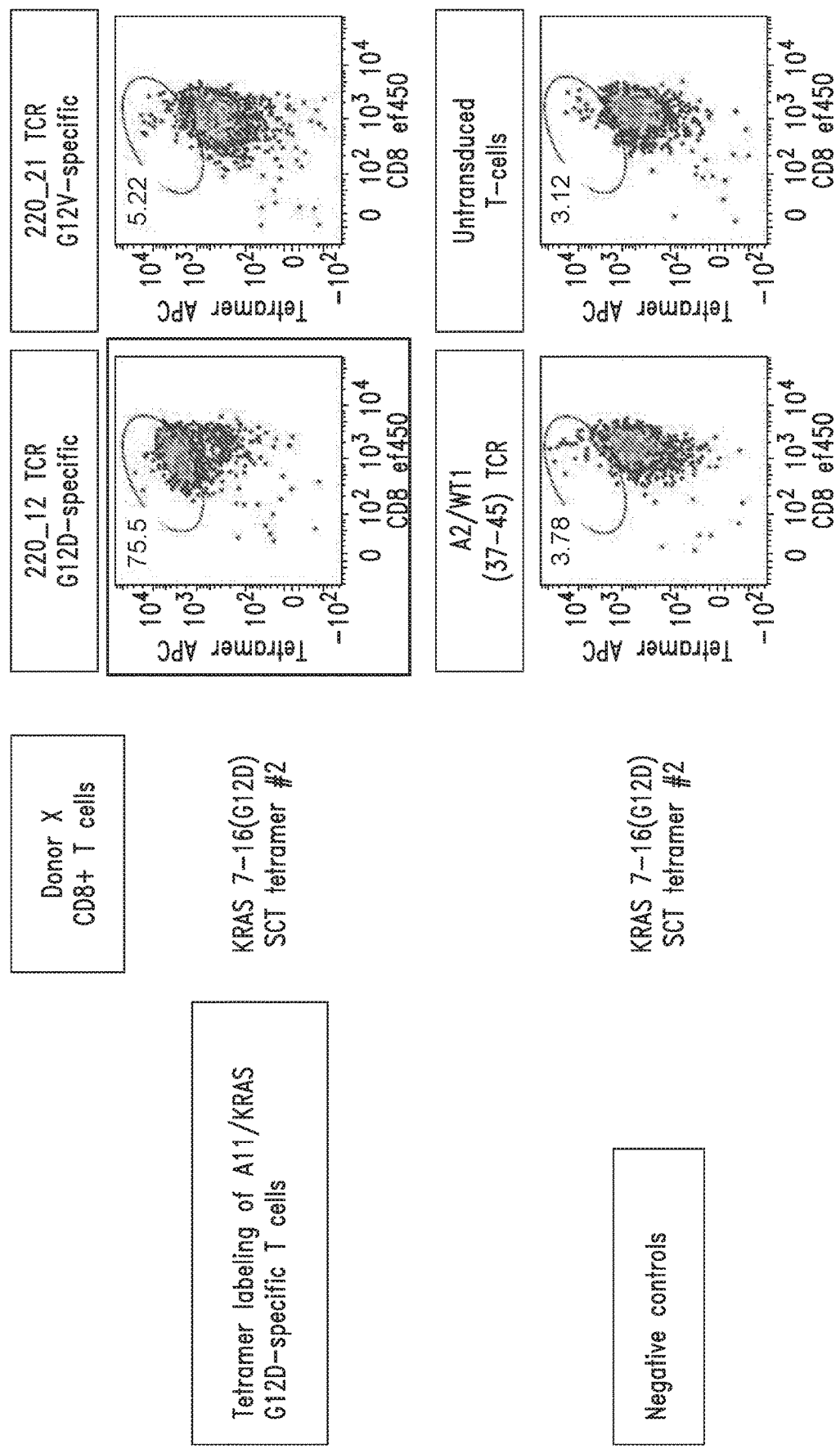
FIG. 31B (1)

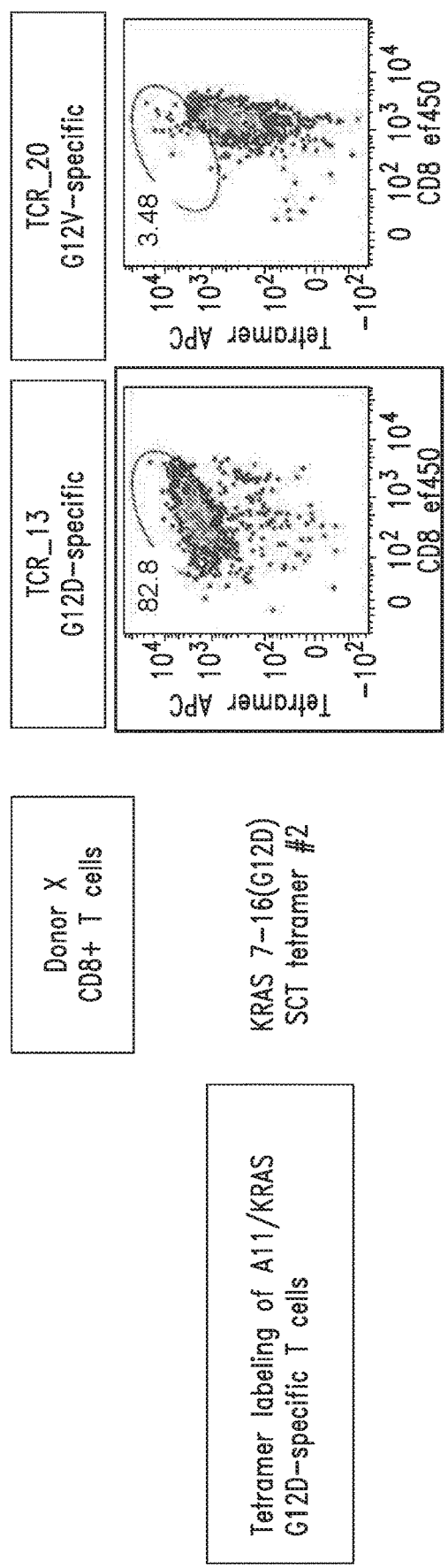
FIG. 31B (2)

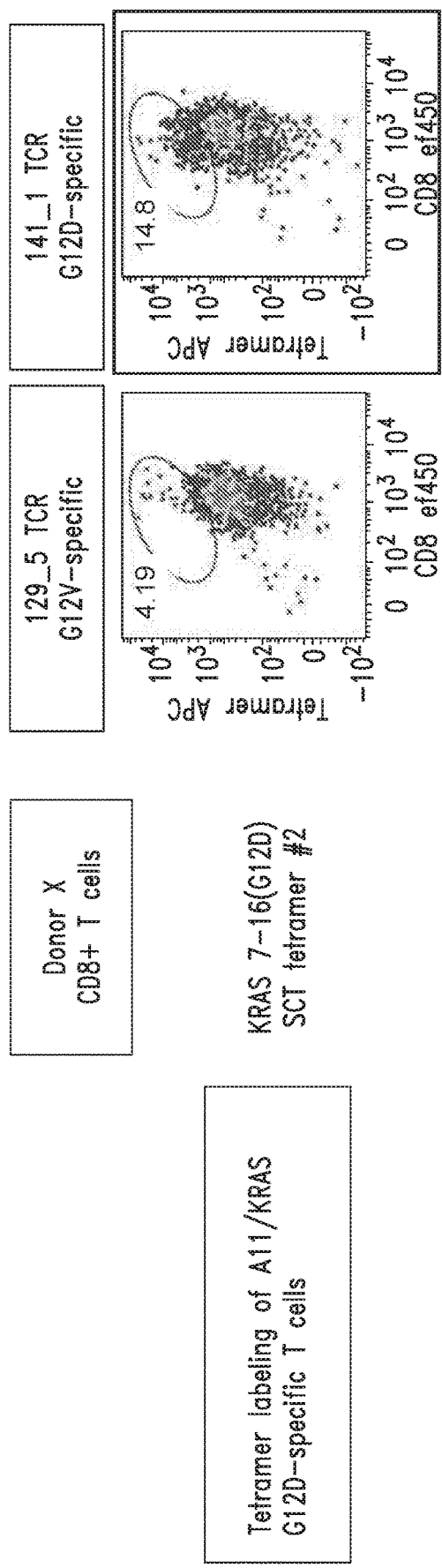
FIG. 31B (3)

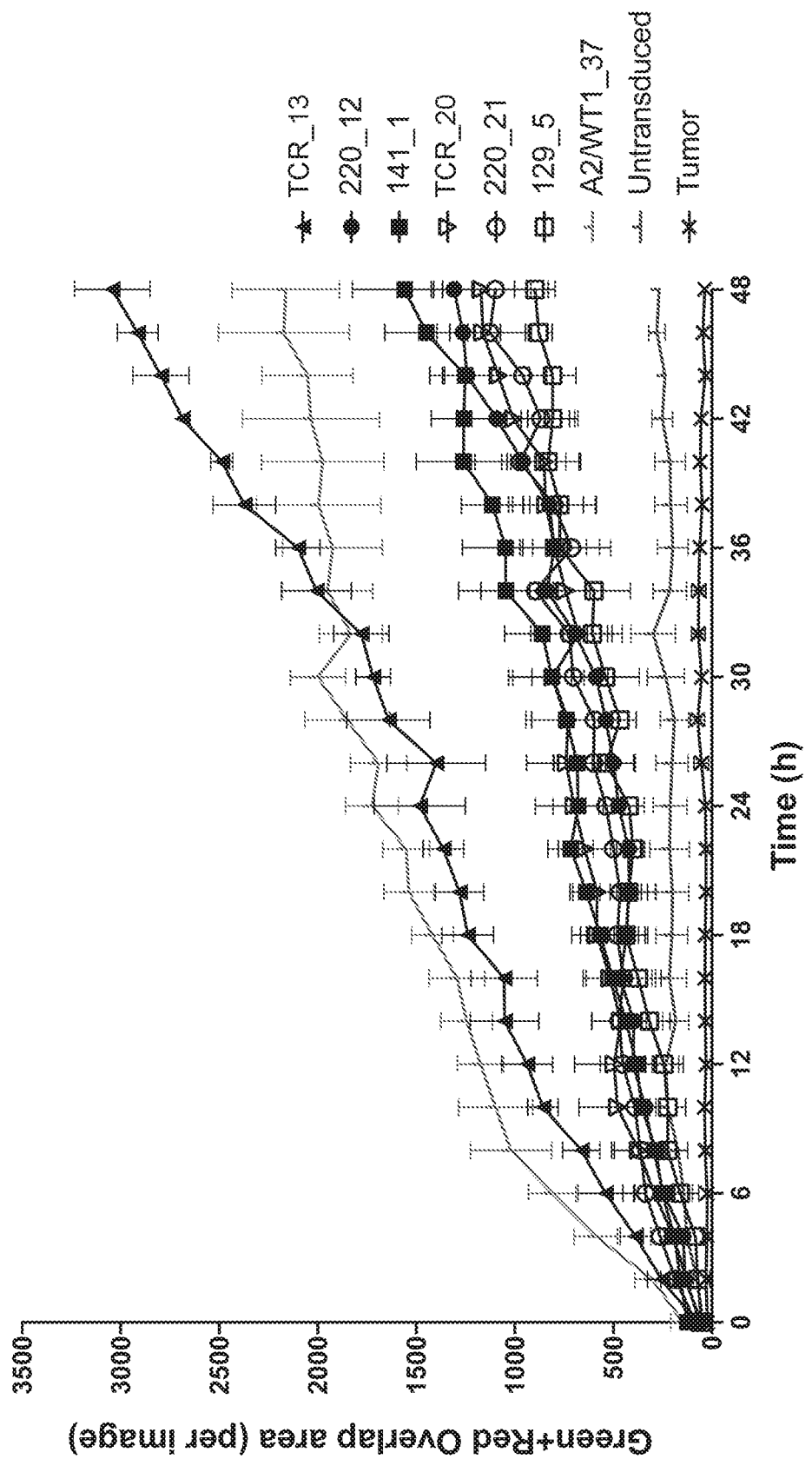

BINDING PROTEINS SPECIFIC FOR RAS NEOANTIGENS AND USES THEREOF

STATEMENT REGARDING SEQUENCE LISTING

The Sequence Listing associated with this application is provided in text format in lieu of a paper copy, and is hereby incorporated by reference into the specification. The name of the text file containing the Sequence Listing is 360056_469C1_SEQUENCE_LISTING.txt. The text file is 653 KB, was created on Aug. 17, 2021, and is being submitted electronically via EFS-Web.

BACKGROUND

Ras family proteins are small GTPases that are involved with transmitting signals within cells, including, for example, transduction of cell proliferation. Exemplary RAS proteins include KRAS (also called C-K-RAS, CFC2, K-RAS2A, K-RAS2B, K-RAS4A, K-RAS4B, KI-RAS, KRAS1, KRAS2, NS, NS3, RALD, RASK2, K-ras, KRAS proto-oncogene, GTPase, and c-Ki-ras2), HRAS, and NRAS. Mutations in RAS proteins that disrupt negative growth signaling can lead to continuous proliferation of the cell. KRAS is one of the most frequently mutated proto-oncogenes in a variety of human cancers, including melanomas, endometrial, thyroid, pancreatic, colorectal, breast, ovarian, and lung cancers, as well as some instances of myeloid leukemias such as AML. New therapies targeting mutant RAS proteins are required.

BRIEF DESCRIPTION OF THE FIGURES

FIGS. 1-8D relate to exemplary HLA-A11/KRAS specific TCRs of the present disclosure.

FIG. 1 shows identification of functional HLA-A11/KRAS-specific T cell lines by functional screening ("Sort 1" for exemplary HLA-A11/KRAS-specific TCRs).

FIG. 2 provides exemplary data from an enrichment scheme wherein exemplary HLA-A11/KRAS-specific TCRs were sorted on CD137 (4-1BB) following stimulation with mixed mutant KRAS peptides FIG. 3 shows that exemplary HLA-A11/KRAS-specific TCRs of the present disclosure are functional in transduced host cells. Data show activation (Nur77 expression) and CD8 expression by the transduced cells following incubation with antigen-loaded target cells.

FIGS. 4A and 4B show that exemplary HLA-A11/KRAS-specific TCRs recognize diverse epitopes. (A) Primary human CD8$^+$ T cells were transduced to express HLA-A11/KRAS-specific TCRs, stimulated for 16 h with mixed KRAS peptides at 1 μg/mL, and labelled using PE-anti-CD137 (4-1BB) mAb and anti-CD8 eFluor® 450 mAb (Thermofisher). (B) Transduced CD8$^+$ T cells were stimulated 4 h with APCs pulsed with individual KRAS peptides (see left-hand column of table) at 1 μg/mL and in the presence of Golgi inhibitors. Cells were then examined for IFN-γ production. "−"=no measurable IFN-γ. "+"=low level of IFN-γ measured. "+++"=high level of IFN-γ measured.

FIGS. 8A-8D show percent killing of KRAS G12D$^+$ (A11/721.221 target cells loaded with 100 ng/ml mutant peptide); NRAS G12D$^+$ (THP-1 cells); and NRAS G12V$^+$ (GA-10.4 cells) tumor lines (flow cytometry killing assay with effector:target cells at the indicated ratios) by T cells transduced with exemplary TCRs of the present disclosure.

FIGS. 9-11 relate to exemplary HLA-A3-compatible KRAS mutant peptides and reactive T cell lines.

FIG. 9 shows predicted HLA-binding affinity of mutated KRAS G12V peptides (10-mer (VVVGA$\underline{V}$GVGK; SEQ ID NO:2); 9-mer (VVGA$\underline{V}$GVK; SEQ ID NO:3)) for HLA-A*0301. Affinity was measured using NetMHC version 3.4 (available online at cbs.dtu.dk/services/NetMHC/).

FIG. 10 shows detection of HLA-A3/KRAS (G12V)-specific T cell lines by tetramer labelling following 3 rounds of peptide stimulation.

FIG. 11 provides exemplary data from an enrichment scheme for HLA-A3/KRAS (G12V)-specific T cells wherein cells were stimulated with peptide and scored on CD137 (4-1BB) or peptide:HLA tetramer.

FIGS. 12-20C relate to HLA-A2-compatible KRAS mutant peptides and exemplary T cell lines and TCRs specific for the same.

FIG. 12 shows HLA-A*02:01 MHC-I binding prediction data (using IEDB) for KRAS sequence spanning 11 aa on either side of a D- or V-mutated G12 position. Similar results were achieved using NetMHCpan, SYFPEITHI, and BiMas (data not shown).

FIGS. 14A-14D show that exemplary HLA-A2 KRAS-specific T cells of the present disclosure respond specifically to KRAS mutant peptides, and can recognize unique antigenic sequences. HLA-A2 G12V and G12D-specific TCRs are sequenced using known techniques. As discussed herein, TCRs were transduced into Jurkat cells and primary T cells and tested for reactivity to antigen, including by measuring expansion, expression of CD137, cytokine production, and specific killing of peptide-pulsed target cells.

FIGS. 15A-16 provide data from tetramer-labelling experiments confirming HLA and peptide specificity of exemplary HLA-A2/KRAS G12V-specific TCRs, as well as relative affinity readings and CD8-independent binding by the exemplary TCRs. FIGS. 15A and 15B show mean fluorescence intensity (MFI) of T cells expressing the indicated HLA-A2-specific TCR in the presence of wild-type HLA-A2/KRAS $(_{5-14}$_G12)-peptide multimers at the indicated concentrations. FIG. 16 provides flow cytometry data showing labelling of T cells transduced to express the indicated TCR, as determined by functional assays with HLA-A2(DM)/KRAS(514_G12V)-peptide multimer. This multimer is assembled from modified HLA-A*02:01 α-3 domain double-mutated (DM) monomers, which cannot bind to CD8.

FIGS. 17-18C show functional avidity ranking of HLA-A2/KRAS G12V-specific TCRs (tested by peptide dose-response after a 4 hr stimulation with individual peptides and labelling with IFN-γ antibody) and determination of specificity to mutant epitope (tested by stimulating T cells with a high dose of wild-type KRAS peptides and labelling with IFN-γ antibody). FIG. 17 shows frequencies of IFN-γ producing T cells in response to mutant vs. wild-type peptides. FIG. 18C shows KRAS$_{5-14}$ G12V log EC$_{50}$ values for certain exemplary HLA-A2-specific TCRs of the present disclosure.

FIG. 19 provides results from a screen of exemplary HLA-A2/KRAS-specific TCR reactivity to endogenously processed and presented peptide (tested by overnight incubation with CFPAC-1 pancreas tumor cells and labelling with CD137/41-BB antibody). Data are flow cytometry plots showing CD137 expression on HLA-A2/KRAS-specific T cells following co-incubation with tumor cells.

FIGS. 20A-20C provide results from Incucyte® killing assays showing that T cells expressing exemplary HLA-A2/KRAS-specific TCRs of the present disclosure effectively and specifically kill CFPAC-1 (A2$^+$ and KRAS G12V$^+$) pancreas cancer cell line. In this assay, activated caspase and NucRed-labelled tumor cell overlap are measured, where increased overlap area equals tumor cell death by apoptosis. Data shown are caspase activation/killing curves for A2/KRAS TCRs. The same control groups are included on each figure, and for ease of reading, data from experimental and control groups are displayed on separate graphs.

FIGS. 21A-31B relate to exemplary HLA-A11/KRAS specific TCRs of the present disclosure.

FIGS. 21A and 21B show killing, of RapidRed-labeled pancreatic tumor cell lines having endogenous G12D mutation and native (A; Panc-1 cell line) or transduced (B; AsPc-1 cell line) HLA-A*11:01 expression, by T cells transduced with the indicated HLA-A11/KRAS-specific TCRs. Data are from IncuCyte® killing assays. (A) A 10:1 effector:target cell ratio was used. (B) A 1:1 effector:target cell ratio was used.

FIGS. 28A and 28B provide flow cytometry data from an initial screen ("Sort 2b" for HLA-A11/KRAS-specific TCRs) showing CD137 labelling of exemplary HLA-A11/KRAS TCR-transduced CD8+ T cells after overnight stimulation with 1 ug/ml wild-type or mutant KRAS peptide (see left edge of the figure).

FIG. 30 provides flow cytometry data showing IFN-γ labelling of exemplary HLA-A11/KRAS TCR-transduced, sorted and expanded CD8$^+$ T cells after 4 hr stimulation with a dose titration of WT KRAS peptides. Data from 2 different CD8$^+$ T cell donors shown for transduced TCRs 13 and 20. As indicated in the figure key, CD8+ T cells from donor X or donor Y were transduced with the indicated TCRs.

FIGS. 31A and 31B provide flow cytometry data showing HLA-A11/KRAS$_{7-16}$_G12D tetramer labelling of CD8$^+$ T cells transduced with certain exemplary KRAS G12D-specific TCR of the present disclosure.

FIGS. 32A-32D provide results from Incucyte® killing assays showing that T cells transduced with exemplary HLA-A11/KRAS-specific TCRs of the present disclosure effectively and specifically kill HLA-A11$^+$ tumor cells expressing KRAS G12D or G12V mutant peptide ((A, B) Panc-1 cells; (C) CFPAC-1 cells; (D) Capan-2 tumor cells). In this assay, activated caspase and NucRed (A, B) or RapidRed-labelled (C, D) tumor cell overlap are measured, where increased overlap area equals tumor cell death by apoptosis. Data shown are caspase activation/killing curves for A11/KRAS TCRs. The same control groups, including a control TCR specific for a Wilm's tumor 1 (WT1) antigen, are included on each graph.

DETAILED DESCRIPTION

Figure 1:
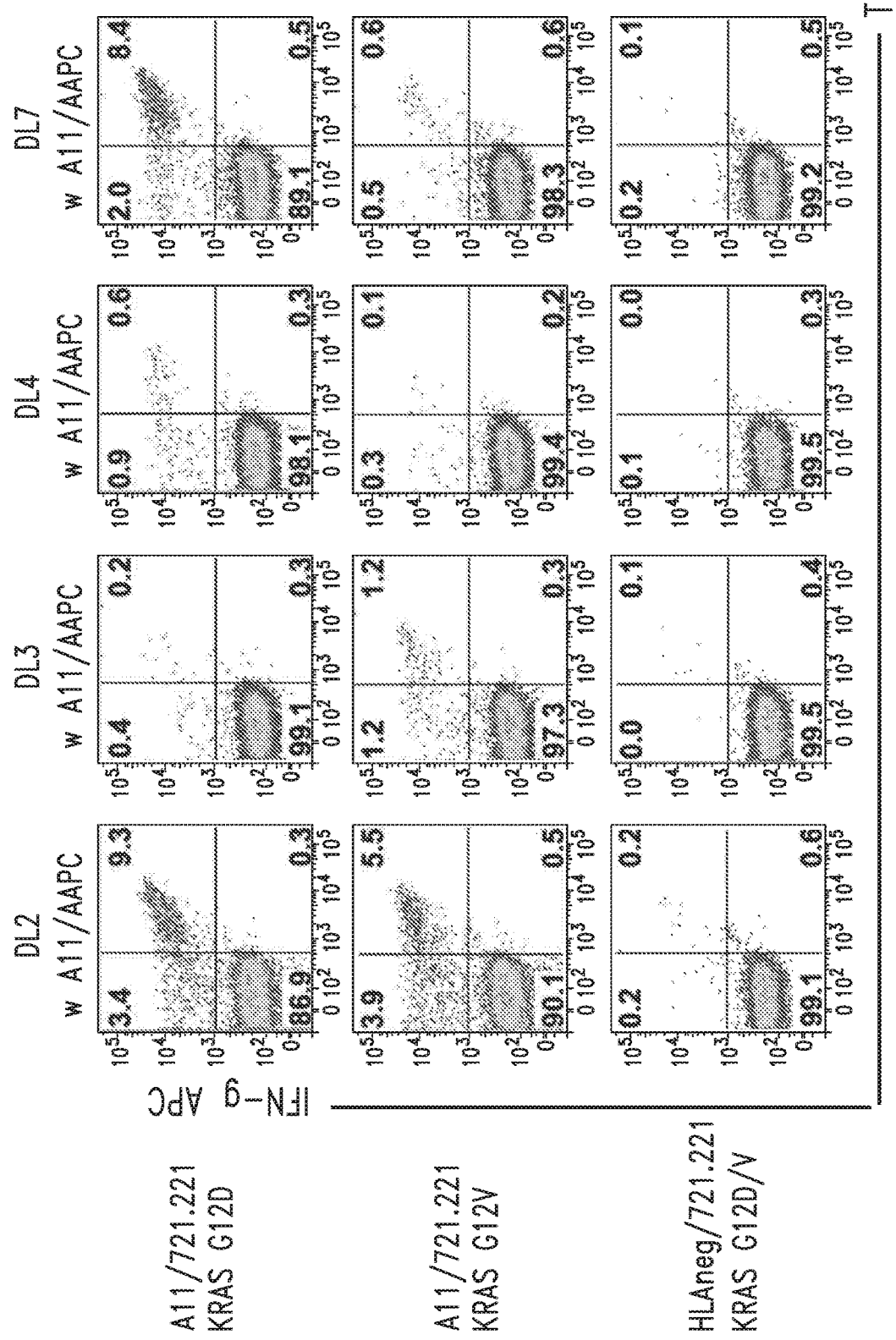
Figure 1:
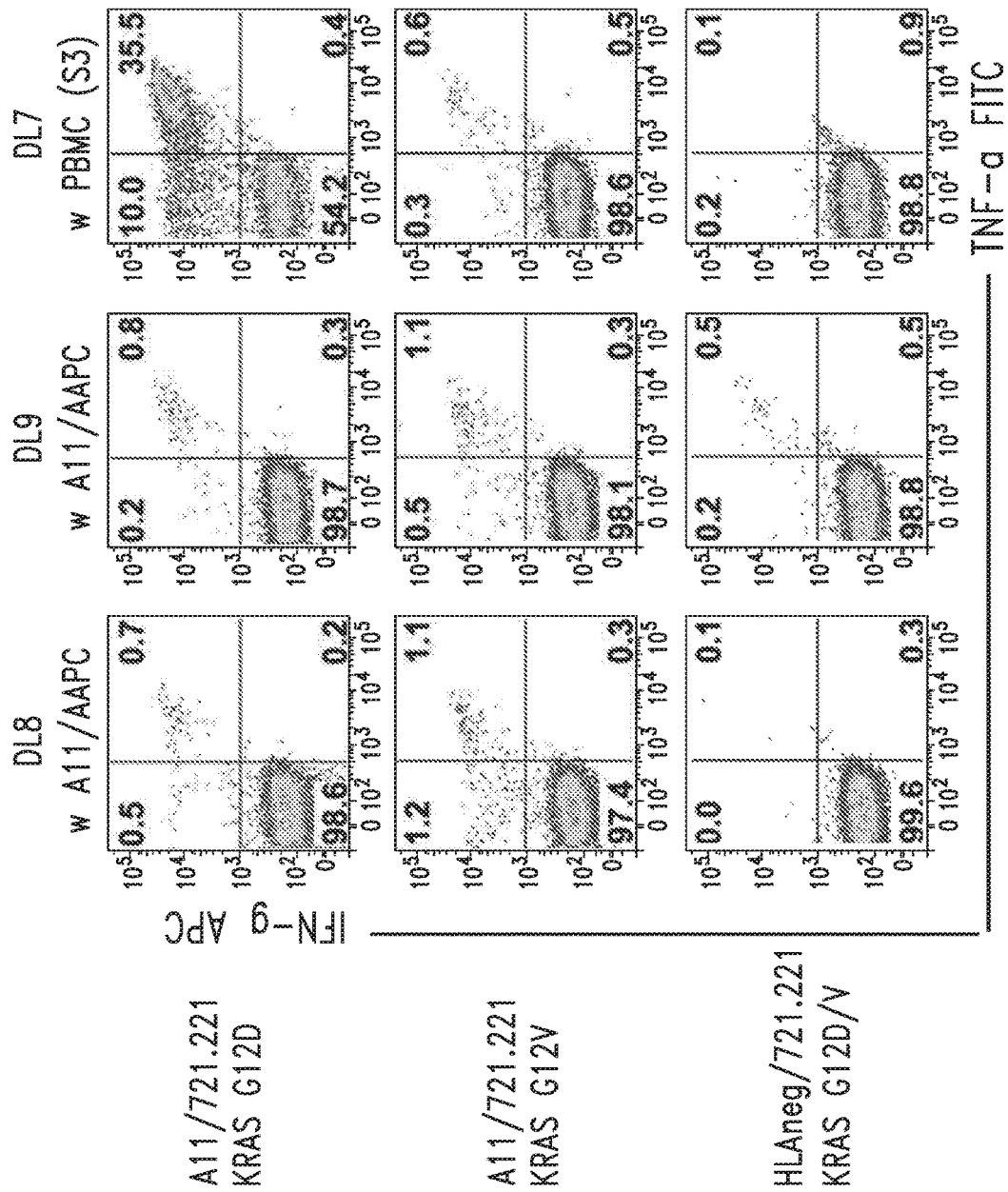

The present disclosure generally relates to binding proteins specific for Ras neoantigens, modified immune cells expressing the same, polynucleotides that encode the binding proteins, and related uses. Mutated Ras proteins (e.g., KRAS, NRAS, HRAS) can produce neoantigens, including a G→V mutation or a G→D mutation at position 12 of the full-length KRAS protein (SEQ ID NO.: 1; UniProt KB P01116) or at position 12 of the full-length NRAS protein (SEQ ID NO.: 6; Uniprot KB P01111) or at position 12 of the full-length HRAS protein (SEQ ID NO.: 216; Uniprot KB P01112).

In the present disclosure, binding proteins that are capable of binding to Ras neoantigens are provided. In certain aspects, binding proteins (and host cells, such as immune cells, that comprise a heterologous polynucleotide that encodes a Ras-specific binding protein of the present disclosure) are provided that comprise a TCR Vα domain and a TCR Vβ domain, wherein the binding proteins are capable of specifically binding to a Ras peptide antigen:HLA complex, wherein the Ras peptide antigen comprises or consists of the amino acid sequence set forth in any one of SEQ ID NOs:2-5 or 198-201. In certain embodiments, the HLA comprises HLA-A2, HLA-A11, or HLA-A3.

In some embodiments, the Ras peptide antigen comprises or consists of the amino acid sequence set forth in any one of SEQ ID NOs:2-5 and the HLA complex comprises a HLA-A*11 molecule or a HLA-A*03 molecule. In certain embodiments, the HLA-A*11 molecule comprises a HLA-A*11:01 molecule. In certain embodiments, HLA-A*03 molecule comprises a HLA-A*03:01 molecule.

In some embodiments, the Ras peptide antigen comprises or consists of the amino acid sequence set forth in any one of SEQ ID NOs:198-201 and the HLA complex comprises a HLA-A*02 molecule. In further embodiments, the HLA-A*02 molecule comprises a HLA-A*02:01 molecule.

Also provided herein are fusion proteins that are capable of specifically binding to a Ras peptide antigen (e.g., in the context of a peptide:HLA complex), wherein the Ras peptide antigen comprises or consists of the amino acid sequence set forth in any one of SEQ ID NOs:2-5 or 198-201, wherein the fusion protein comprises: (i) an extracellular component that can comprising a binding domain (e.g., of a Ras-specific binding protein (e.g., TCR)) as disclosed herein; (ii) an intracellular component; and (iii) a transmembrane component disposed between the extracellular component and the intracellular component.

In any of the herein disclosed embodiments, a binding protein (or at least a binding domain of a fusion protein) can be human, humanized, or chimeric. In certain embodiments, a binding protein or a binding domain of a fusion protein is human. Presently disclosed binding proteins, fusion proteins, and host cells (e.g., T cells, NK cells, NK-T cells) are useful for treating a disease or disorder associated with a KRAS neoantigen, such as, for example, a cancer. Presently disclosed binding proteins can also bind to G12V or G12D antigens arising in human NRAS (SEQ ID NO:6) or human HRAS (SEQ ID NO:216), which proteins comprise an identical sequence to KRAS in the region near residue G12. Accordingly, the disclosed compositions are useful in treating disease or disorders associated with a KRAS neoantigen, with a NRAS neoantigen comprising a G12V or a G12D mutation, or with a HRAS neoantigen comprising a G12V or a G12D mutation, or any combination thereof.

Also provided are polynucleotides that encode Ras-specific binding proteins or fusion proteins, host cells comprising the polynucleotides, and related compositions.

In another aspect, immunogenic polypeptides are provided that comprise or consist of the amino acid sequence set forth in any one of SEQ ID NOs:198-201, as well as compositions comprising the same. Presently disclosed immunogenic polypeptides are useful, for example, in a vaccine composition for treating or preventing a disease associated with a Ras mutation, for eliciting an immune response in a subject, and for identifying a binding protein (e.g., TCR or CAR) that specifically binds to a Ras peptide antigen.

Also provided are methods and uses of the presently disclosed binding proteins, polynucleotides, vectors, host cells, immunogenic polypeptides, and related compositions, for the treatment of a disease or disorder associated with a KRAS, NRAS, and/or HRAS mutation as provided herein.

Prior to setting forth this disclosure in more detail, it may be helpful to an understanding thereof to provide definitions of certain terms to be used herein. Additional definitions are set forth throughout this disclosure.

In the present description, any concentration range, percentage range, ratio range, or integer range is to be understood to include the value of any integer within the recited range and, when appropriate, fractions thereof (such as one tenth and one hundredth of an integer), unless otherwise indicated. Also, any number range recited herein relating to any physical feature, such as polymer subunits, size or thickness, are to be understood to include any integer within the recited range, unless otherwise indicated. As used herein, the term "about" means±20% of the indicated range, value, or structure, unless otherwise indicated. It should be understood that the terms "a" and "an" as used herein refer to "one or more" of the enumerated components. The use of the alternative (e.g., "or") should be understood to mean either one, both, or any combination thereof of the alternatives. As used herein, the terms "include", "have", and "comprise" are used synonymously, which terms and variants thereof are intended to be construed as non-limiting.

In addition, it should be understood that the individual compounds, or groups of compounds, derived from the various combinations of the structures and substituents described herein, are disclosed by the present application to the same extent as if each compound or group of compounds was set forth individually. Thus, selection of particular structures or particular substituents is within the scope of the present disclosure.

The term "consisting essentially of" is not equivalent to "comprising" and refers to the specified materials or steps of a claim, or to those that do not materially affect the basic characteristics of a claimed subject matter. For example, a protein domain, region, or module (e.g., a binding domain, hinge region, linker module) or a protein (which may have one or more domains, regions, or modules) "consists essentially of" a particular amino acid sequence when the amino acid sequence of a domain, region, module, or protein includes extensions, deletions, mutations, or a combination thereof (e.g., amino acids at the amino- or carboxy-terminus or between domains) that, in combination, contribute to at most 20% (e.g., at most 15%, 10%, 8%, 6%, 5%, 4%, 3%, 2% or 1%) of the length of a domain, region, module, or protein and do not substantially affect (i.e., do not reduce the activity by more than 50%, such as no more than 40%, 30%, 25%, 20%, 15%, 10%, 5%, or 1%) the activity of the domain(s), region(s), module(s), or protein (e.g., the target binding affinity or avidity of a binding protein).

As used herein, a "hematopoietic progenitor cell" is a cell that can be derived from hematopoietic stem cells or fetal tissue and is capable of further differentiation into mature cells types (e.g., immune system cells). Exemplary hematopoietic progenitor cells include those with a CD24$^{Lo}$ Lin$^-$ CD117$^+$ phenotype or those found in the thymus (referred to as progenitor thymocytes).

As used herein, an "immune system cell" means any cell of the immune system that originates from a hematopoietic stem cell in the bone marrow, which gives rise to two major lineages, a myeloid progenitor cell (which give rise to myeloid cells such as monocytes, macrophages, dendritic cells, meagakaryocytes and granulocytes) and a lymphoid progenitor cell (which give rise to lymphoid cells such as T cells, B cells and natural killer (NK) cells). Exemplary immune system cells include a $CD4^+$ T cell, a $CD8^+$ T cell, a $CD4^-$ $CD8^-$ double negative T cell, a γδ T cell, a regulatory T cell, a natural killer cell, a natural killer T cell, and a dendritic cell. Macrophages and dendritic cells can be referred to as "antigen presenting cells" or "APCs," which are specialized cells that can activate T cells when a major histocompatibility complex (MHC) receptor on the surface of the APC complexed with a peptide interacts with a TCR on the surface of a T cell.

A "T cell" or "T lymphocyte" is an immune system cell that matures in the thymus and produces a T cell receptors (TCR). T cells can be naïve ("$T_N$"; not exposed to antigen; increased expression of CD62L, CCR7, CD28, CD3, CD127, and CD45RA, and decreased or no expression of CD45RO as compared to $T_{CM}$ (described herein)), memory T cells ($T_M$) (antigen experienced and long-lived), including stem cell memory T cells, and effector cells (antigen-experienced, cytotoxic). $T_M$ can be further divided into subsets of central memory T cells ($T_{CM}$ expresses CD62L, CCR7, CD28, CD95, CD45RO, and CD127) and effector memory T cells ($T_{EM}$, express CD45RO, decreased expression of CD62L, CCR7, CD28, and CD45RA). Effector T cells ($T_E$) refers to antigen-experienced $CD8^+$ cytotoxic T lymphocytes that express CD45RA, have decreased expression of CD62L, CCR7, and CD28 as compared to $T_{CM}$, and are positive for granzyme and perforin. Helper T cells ($T_H$) are $CD4^+$ cells that influence the activity of other immune cells by releasing cytokines. $CD4^+$ T cells can activate and suppress an adaptive immune response, and which of those two functions is induced will depend on presence of other cells and signals. T cells can be collected using known techniques, and the various subpopulations or combinations thereof can be enriched or depleted by known techniques, such as by affinity binding to antibodies, flow cytometry, or immunomagnetic selection. Other exemplary T cells include regulatory T cells, such as $CD4^+$ $CD25^+$ ($Foxp3^+$) regulatory T cells and Treg17 cells, as well as Tr1, Th3, $CD8^+$ $CD28^-$, and Qa-1 restricted T cells.

"T cell receptor" (TCR) refers to an immunoglobulin superfamily member having a variable binding domain, a constant domain, a transmembrane region, and a short cytoplasmic tail; see, e.g., Janeway et al., Immunobiology: The Immune System in Health and Disease, 3rd Ed., Current Biology Publications, p. 433, 1997) capable of specifically binding to an antigen peptide bound to a MHC receptor. A TCR can be found on the surface of a cell or in soluble form and generally is comprised of a heterodimer having α and β chains (also known as TCR α and TCRβ, respectively), or γ and δ chains (also known as TCRγ and TCRδ, respectively). In certain embodiments, a polynucleotide encoding a binding protein of this disclosure, e.g., a TCR, can be codon optimized to enhance expression in a particular host cell, such, for example, as a cell of the immune system, a hematopoietic stem cell, a T cell, a primary T cell, a T cell line, a NK cell, or a natural killer T cell (Scholten et al., Clin. Immunol. 119:135, 2006). Exemplary T cells that can express binding proteins and TCRs of this disclosure include $CD4^+$ T cells, $CD8^+$ T cells, and related subpopulations thereof (e.g., naïve, central memory, stem cell memory, effector memory).

Like other immunoglobulins (e.g., antibodies), the extracellular portion of TCR chains (e.g., α-chain, β-chain) contain two immunoglobulin domains, a variable domain (e.g., α-chain variable domain or $V_α$, β-chain variable domain or $V_β$; typically amino acids 1 to 116 based on Kabat numbering (Kabat et al., "Sequences of Proteins of Immunological Interest, US Dept. Health and Human Services, Public Health Service National Institutes of Health, 1991, $5^{th}$ ed.)) at the N-terminus, and one constant domain (e.g., α-chain constant domain or $C_α$, typically 5 amino acids 117 to 259 based on Kabat, β-chain constant domain or $C_β$, typically amino acids 117 to 295 based on Kabat) adjacent the cell membrane. Also, like immunoglobulins, the variable domains contain complementary determining regions (CDRs) separated by framework regions (FRs) (see, e.g., Jores et al., Proc. Nat'l Acad. Sci. USA 87:9138, 1990; Chothia et al., EMBO J. 7:3745, 1988; see also Lefranc et al., Dev. Comp. Immunol. 27:55, 2003). The source of a TCR as used in the present disclosure may be from various animal species, such as a human, mouse, rat, rabbit, or other mammal.

The term "variable region" or "variable domain" refers to the domain of an immunoglobulin superfamily binding protein (e.g., a TCR α-chain or β-chain (or γ chain and δ chain for γδ TCRs)) that is involved in binding of the immunoglobulin superfamily binding protein (e.g., TCR) to antigen. The variable domains of the α-chain and β-chain (Vα and Vβ, respectively) of a native TCR generally have similar structures, with each domain comprising four generally conserved framework regions (FRs) and three CDRs. The Vα domain is encoded by two separate DNA segments, the variable gene segment and the joining gene segment (V-J); the Vβ domain is encoded by three separate DNA segments, the variable gene segment, the diversity gene segment, and the joining gene segment (V-D-J). A single Vα or Vβ domain may be sufficient to confer antigen-binding specificity. Furthermore, TCRs that bind a particular antigen may be isolated using a Vα or Vβ domain from a TCR that binds the antigen to screen a library of complementary Vα or Vβ domains, respectively.

The terms "complementarity determining region," and "CDR," are synonymous with "hypervariable region" or "HVR," and are known in the art to refer to sequences of amino acids within immunoglobulin (e.g., TCR) variable regions, which confer antigen specificity and/or binding affinity and are separated from one another in primary amino acid sequence by framework regions. In general, there are three CDRs in each TCR α-chain variable region (αCDR1, αCDR2, αCDR3) and three CDRs in each TCR β-chain variable region (βCDR1, βCDR2, βCDR3). In TCRs, CDR3 is thought to be the main CDR responsible for recognizing processed antigen. In general, CDR1 and CDR2 interact mainly or exclusively with the MHC.

CDR1 and CDR2 are encoded within the variable gene segment of a TCR variable region-coding sequence, whereas CDR3 is encoded by the region spanning the variable and joining segments for Vα, or the region spanning variable, diversity, and joining segments for Vβ. Thus, if the identity of the variable gene segment of a Vα or Vβ is known, the sequences of their corresponding CDR1 and CDR2 can be deduced; e.g., according to a numbering scheme as described herein. Compared with CDR1 and CDR2, CDR3 is typically significantly more diverse due to the addition and loss of nucleotides during the recombination process.

TCR variable domain sequences can be aligned to a numbering scheme (e.g., Kabat, Chothia, EU, IMGT, Enhanced Chothia, and Aho), allowing equivalent residue positions to be annotated and for different molecules to be compared using, for example, ANARCI software tool (2016, Bioinformatics 15:298-300). A numbering scheme provides a standardized delineation of framework regions and CDRs in the TCR variable domains. In certain embodiments, a CDR of the present disclosure is identified according to the IMGT numbering scheme (Lefranc et al., *Dev. Comp. Immunol.* 27:55, 2003; imgt.org/IMGTindex/V-QUEST.php).

As used herein, the term "CD8 co-receptor" or "CD8" means the cell surface glycoprotein CD8, either as an alpha-alpha homodimer or an alpha-beta heterodimer. The CD8 co-receptor assists in the function of cytotoxic T cells ($CD8^+$) and functions through signaling via its cytoplasmic tyrosine phosphorylation pathway (Gao and Jakobsen, *Immunol. Today* 21:630-636, 2000; Cole and Gao, *Cell. Mol. Immunol.* 1:81-88, 2004). There are five (5) known human CD8 beta chain isoforms (see UniProtKB identifier P10966) and a single known human CD8 alpha chain isoform (see UniProtKB identifier P01732). See also SEQ ID NOs.:685-692.

"CD4" is an immunoglobulin co-receptor glycoprotein that assists the TCR in communicating with antigen-presenting cells (see, Campbell & Reece, *Biology* 909 (Benjamin Cummings, Sixth Ed., 2002)). CD4 is found on the surface of immune cells such as T helper cells, monocytes, macrophages, and dendritic cells, and includes four immunoglobulin domains (D1 to D4) that are expressed at the cell surface. During antigen presentation, CD4 is recruited, along with the TCR complex, to bind to different regions of the MHCII molecule (CD4 binds MHCII $\beta2$, while the TCR complex binds MHCII $\alpha1/\beta1$). Without wishing to be bound by theory, it is believed that close proximity to the TCR complex allows CD4-associated kinase molecules to phosphorylate the immunoreceptor tyrosine activation motifs (ITAMs) present on the cytoplasmic domains of CD3. This activity is thought to amplify the signal generated by the activated TCR in order to produce or recruit various types immune system cells, including T helper cells, and immune responses.

In certain embodiments, a TCR is found on the surface of T cells (or T lymphocytes) and associates with a CD3 complex. "CD3" is a multi-protein complex of six chains (see, Abbas and Lichtman, 2003; Janeway et al., p. 172 and 178, 1999) that is associated with antigen signaling in T cells. In mammals, the complex comprises a $CD3\gamma$ chain, a $CD3\delta$ chain, two $CD3\epsilon$ chains, and a homodimer of $CD3\zeta$ chains. The $CD3\gamma$, $CD3\beta$, and $CD3\epsilon$ chains are related cell surface proteins of the immunoglobulin superfamily containing a single immunoglobulin domain. The transmembrane regions of the $CD3\gamma$, $CD3\beta$, and $CD3\epsilon$ chains are negatively charged, which is believed to allow these chains to associate with positively charged regions of T cell receptor chains. The intracellular tails of the $CD3\gamma$, $CD3\beta$, and $CD3\epsilon$ chains each contain a single conserved motif known as an immunoreceptor tyrosine based activation motif or ITAM, whereas each $CD3\zeta$ chain has three. Without wishing to be bound by theory, it is believed that the ITAMs are important for the signaling capacity of a TCR complex. CD3 as used in the present disclosure may be from various animal species, including human, mouse, rat, or other mammals.

As used herein, "TCR complex" refers to a complex formed by the association of CD3 with TCR. For example, a TCR complex can be composed of a $CD3\gamma$ chain, a $CD3\beta$ chain, two $CD3\epsilon$ chains, a homodimer of $CD3\zeta$ chains, a $TCR\alpha$ chain, and a $TCR\beta$ chain. Alternatively, a TCR complex can be composed of a $CD3\gamma$ chain, a $CD3\beta$ chain, two $CD3\epsilon$ chains, a homodimer of $CD3\zeta$ chains, a $TCR\gamma$ chain, and a $TCR\beta$ chain.

A "component of a TCR complex", as used herein, refers to a TCR chain (i.e., $TCR\alpha$, $TCR\beta$, $TCR\gamma$ or $TCR\delta$), a CD3 chain (i.e., $CD3\gamma$, $CD3\delta$, $CD3\epsilon$ or $CD3\zeta$), or a complex formed by two or more TCR chains or CD3 chains (e.g., a complex of $TCR\alpha$ and $TCR\beta$, a complex of $TCR\gamma$ and $TCR\delta$, a complex of $CD3\epsilon$ and $CD3\delta$, a complex of $CD3\gamma$ and $CD3\epsilon$, or a sub-TCR complex of $TCR\alpha$, $TCR\beta$, $CD3\gamma$, $CD3\delta$, and two $CD3\epsilon$ chains).

"Chimeric antigen receptor" (CAR) refers to a fusion protein that is engineered to contain two or more naturally occurring amino acid sequences, domains, or motifs, linked together in a way that does not occur naturally or does not occur naturally in a host cell, which fusion protein can function as a receptor when present on a surface of a cell. CARs can include an extracellular portion comprising an antigen-binding domain (e.g., obtained or derived from an immunoglobulin or immunoglobulin-like molecule, such as a TCR binding domain derived or obtained from a TCR specific for a cancer antigen, a scFv derived or obtained from an antibody, or an antigen-binding domain derived or obtained from a killer immunoreceptor from an NK cell) linked to a transmembrane domain and one or more intracellular signaling domains (optionally containing co-stimulatory domain(s)) (see, e.g., Sadelain et al., *Cancer Discov.,* 3(4):388 (2013); see also Harris and Kranz, Trends *Pharmacol. Sci.,* 37(3):220 (2016), Stone et al., *Cancer Immunol. Immunother.,* 63(11):1163 (2014), and Walseng et al., *Scientific Reports* 7:10713 (2017), which CAR constructs and methods of making the same are incorporated by reference herein). CARs of the present disclosure that specifically bind to a Ras antigen (e.g., in the context of a peptide:HLA complex) comprise a TCR $V\alpha$ domain and a $V\beta$ domain.

Any polypeptide of this disclosure can, as encoded by a polynucleotide sequence, comprise a "signal peptide" (also known as a leader sequence, leader peptide, or transit peptide). Signal peptides target newly synthesized polypeptides to their appropriate location inside or outside the cell. A signal peptide may be removed from the polypeptide during or once localization or secretion is completed. Polypeptides that have a signal peptide are referred to herein as a "pre-protein" and polypeptides having their signal peptide removed are referred to herein as "mature" proteins or polypeptides. In any of the herein disclosed embodiments, a binding protein or fusion protein comprises, or is, a mature protein, or is or comprises a pre-protein.

A "linker" refers to an amino acid sequence that connects two proteins, polypeptides, peptides, domains, regions, or motifs and may provide a spacer function compatible with interaction of the two sub-binding domains so that the resulting polypeptide retains a specific binding affinity (e.g., scTCR) to a target molecule or retains signaling activity (e.g., TCR complex). In certain embodiments, a linker is comprised of about two to about 35 amino acids, for instance, or about four to about 20 amino acids or about eight to about 15 amino acids or about 15 to about 25 amino acids. Exemplary linkers include glycine-serine linkers (e.g., SEQ ID NOs:214 and 215).

"Antigen" or "Ag" as used herein refers to an immunogenic molecule that provokes an immune response. This immune response may involve antibody production, activation of specific immunologically competent cells (e.g., T cells), or both. An antigen (immunogenic molecule) may be, for example, a peptide, glycopeptide, polypeptide, glycopolypeptide, polynucleotide, polysaccharide, lipid or the like. It is readily apparent that an antigen can be synthesized, produced recombinantly, or derived from a biological sample. Exemplary biological samples that can contain one or more antigens include tissue samples, tumor samples, cells, biological fluids, or combinations thereof. Antigens can be produced by cells that have been modified or genetically engineered to express an antigen, or that endogenously (e.g., without modification or genetic engineering by human intervention) express a mutation or polymorphism that is immunogenic.

A "neoantigen," as used herein, refers to a host cellular product containing a structural change, alteration, or mutation that creates a new antigen or antigenic epitope that has not previously been observed in the subject's genome (i.e., in a sample of healthy tissue from the subject) or been "seen" or recognized by the host's immune system, which: (a) is processed by the cell's antigen-processing and transport mechanisms and presented on the cell surface in association with an MHC (e.g., HLA) molecule; and (b) elicits an immune response (e.g., a cellular (T cell) response). Neoantigens may originate, for example, from coding polynucleotides having alterations (substitution, addition, deletion) that result in an altered or mutated product, or from the insertion of an exogenous nucleic acid molecule or protein into a cell, or from exposure to environmental factors (e.g., chemical, radiological) resulting in a genetic change. Neoantigens may arise separately from a tumor antigen, or may arise from or be associated with a tumor antigen. "Tumor neoantigen" (or "tumor-specific neoantigen") refers to a protein comprising a neoantigenic determinant associated with, arising from, or arising within a tumor cell or plurality of cells within a tumor. Tumor neoantigenic determinants are found on, for example, antigenic tumor proteins or peptides that contain one or more somatic mutations or chromosomal rearrangements encoded by the DNA of tumor cells (e.g., pancreas cancer, lung cancer, colorectal cancers), as well as proteins or peptides from viral open reading frames associated with virus-associated tumors (e.g., cervical cancers, some head and neck cancers). The terms "antigen" and "neoantigen" are used interchangeably herein when referring to a Ras antigen comprising a mutation (G12D, G12V) as disclosed herein.

The term "epitope" or "antigenic epitope" includes any molecule, structure, amino acid sequence or protein determinant that is recognized and specifically bound by a cognate binding molecule, such as an immunoglobulin, T cell receptor (TCR), chimeric antigen receptor, or other binding molecule, domain or protein. Epitopic determinants generally contain chemically active surface groupings of molecules, such as amino acids or sugar side chains, and can have specific three dimensional structural characteristics, as well as specific charge characteristics.

As used herein, the term "KRAS (or NRAS or HRAS) antigen (or neoantigen)" or "KRAS (or NRAS or HRAS) peptide antigen (or neoantigen)" or "KRAS (NRAS or HRAS) peptide" refers to a naturally or synthetically produced peptide portion of a KRAS or NRAS or HRAS protein ranging in length from about 7 amino acids, about 8 amino acids, about 9 amino acids, about 10 amino acids, up to about 20 amino acids, and comprising at least one amino acid alteration caused by a G12V or a G12D mutation (wherein position 12 is in reference to the full-length KRAS protein sequence set forth in SEQ ID NO:1; and is also in reference of the full-length NRAS and HRAS protein sequence set forth in SEQ ID NOs.: 6 and 216, respectively), which peptide can form a complex with a MHC (e.g., HLA) molecule, and a binding protein of this disclosure specific for a KRAS or NRAS or HRAS peptide:MHC (e.g., HLA) complex can specifically bind to such as complex. An exemplary KRAS (or NRAS or HRAS) antigen comprises or consists of a peptide having the amino acid sequence of any one of SEQ ID NOs:2-5 or 198-201."

"Major histocompatibility complex" (MHC) refers to glycoproteins that deliver peptide antigens to a cell surface of all nucleated cells. MHC class I molecules are heterodimers having a membrane spanning a chain (with three $\alpha$ domains) and a non-covalently associated $\beta_2$ microglobulin. MHC class II molecules are composed of two transmembrane glycoproteins, $\alpha$ and $\beta$, both of which span the membrane. Each chain comprises two domains. MHC class I molecules deliver peptides originating in the cytosol to the cell surface, where a peptide:MHC complex is recognized by $CD8^+$ T cells. MHC class II molecules deliver peptides originating in the vesicular system to the cell surface, where they are recognized by $CD4^+$ T cells. Human MHC is referred to as human leukocyte antigen (HLA). HLAs corresponding to "class I" MHC present peptides from inside the cell and include, for example, HLA-A, HLA-B, and HLA-C. Alleles include, for example, HLA A*11:01; HLA-A*03:01; and HLA-A*02:01. HLAs corresponding to "class II" MHC present peptides from outside the cell and include, for example, HLA-DP, HLA-DM, HLA-DOA, HLA-DOB, HLA-DQ, and HLA-DR.

Principles of antigen processing by antigen presenting cells (APC) (such as dendritic cells, macrophages, lymphocytes or other cell types), and of antigen presentation by APC to T cells, including major histocompatibility complex (MHC)-restricted presentation between immunocompatible (e.g., sharing at least one allelic form of an MHC gene that is relevant for antigen presentation) APC and T cells, are well-established (see, e.g., Murphy, Janeway's Immunobiology ($8^{th}$ Ed) 2011 Garland Science, NY; chapters 6, 9 and 16). For example, processed antigen peptides originating in the cytosol (e.g., tumor antigen, intracellular pathogen) are generally from about 7 amino acids to about 11 amino acids in length and will associate with class I MHC (HLA) molecules, whereas peptides processed in the vesicular system (e.g., bacterial, viral) will vary in length from about 10 amino acids to about 25 amino acids and associate with class II MHC (HLA) molecules.

The term "KRAS-specific binding protein," as used herein, refers to a protein or polypeptide, such as, for example, a TCR, a scTCR, or CAR, that binds to a KRAS peptide antigen or a NRAS peptide antigen or a HRAS peptide antigen (or to a KRAS or NRAS or HRAS peptide antigen:HLA complex, e.g., on a cell surface), and does not bind a peptide that does not contain the KRAS or NRAS or HRAS peptide and does not bind to an HLA complex containing such a peptide.

Binding proteins of this disclosure, such as TCRs, scTCRs, and CARs, will contain a binding domain specific for a target. A "binding domain" (also referred to as a "binding region" or "binding moiety"), as used herein, refers to a molecule or portion thereof (e.g., peptide, oligopeptide, polypeptide, protein) that possesses the ability to specifically and non-covalently associate, unite, or combine with a target (e.g., KRAS or NRAS or HRAS peptide or KRAS or NRAS or HRAS peptide:MHC complex). A binding domain includes any naturally occurring, synthetic, semi-synthetic, or recombinantly produced binding partner for a biological molecule, a molecular complex (i.e. complex comprising two or more biological molecules), or other target of interest. Exemplary binding domains include immunoglobulin variable regions or single chain constructs comprising the same (e.g., single chain TCR (scTCR)).

In certain embodiments, a Ras-specific binding protein binds to a KRAS (or NRAS or HRAS) peptide (or a KRAS (or NRAS or HRAS):HLA complex) with a $K_d$ of less than about $10^{-8}$ M, less than about $10^{-9}$ M, less than about $10^{-10}$ M, less than about $10^{-11}$ M, less than about $10^{-12}$ M, or less than about $10^{-13}$ M, or with an affinity that is about the same as, at least about the same as, or is greater than at or about the affinity exhibited by an exemplary SRas-specific binding protein provided herein, such as any of the Ras-specific TCRs provided herein, for example, as measured by the same assay. In certain embodiments, a Ras-specific binding protein comprises a Ras-specific immunoglobulin superfamily binding protein or binding portion thereof.

As used herein "specifically binds" or "specific for" refers to an association or union of a binding protein (e.g., TCR receptor) or a binding domain (or fusion protein thereof) to a target molecule with an affinity or $K_a$ (i.e., an equilibrium association constant of a particular binding interaction with units of 1/M) equal to or greater than $10^5$ M$^{-1}$ (which equals the ratio of the on-rate $[k_{on}]$ to the off-rate $[k_{off}]$ for this association reaction), while not significantly associating or uniting with any other molecules or components in a sample. Binding proteins or binding domains (or fusion proteins thereof) may be classified as "high affinity" binding proteins or binding domains (or fusion proteins thereof) or as "low affinity" binding proteins or binding domains (or fusion proteins thereof). "High affinity" binding proteins or binding domains refer to those binding proteins or binding domains having a $K_a$ of at least $10^7$ M$^{-1}$, at least $10^8$ M$^{-1}$, at least $10^9$ M$^{-1}$, at least $10^{10}$ M$^{-1}$, at least $10^{11}$ M$^{-1}$, at least $10^{12}$ M$^{-1}$, or at least $10^{13}$ M$^{-1}$. "Low affinity" binding proteins or binding domains refer to those binding proteins or binding domains having a $K_a$ of up to $10^7$ M$^{-1}$, up to $10^6$ M$^{-1}$, up to $10^5$ M$^{-1}$. Alternatively, affinity can be defined as an equilibrium dissociation constant ($K_d$) of a particular binding interaction with units of M (e.g., $10^{-5}$ M to $10^{-13}$ M).

In certain embodiments, a receptor or binding domain may have "enhanced affinity," which refers to a selected or engineered receptors or binding domain with stronger binding to a target antigen than a wild type (or parent) binding domain. For example, enhanced affinity may be due to a $K_a$ (equilibrium association constant) for the target antigen that is higher than the wild type binding domain, due to a $K_d$ (dissociation constant) for the target antigen that is less than that of the wild type binding domain, due to an off-rate (koff) for the target antigen that is less than that of the wild type binding domain, or a combination thereof.

A variety of assays are known for identifying binding domains of the present disclosure that specifically bind a particular target, as well as determining binding domain or fusion protein affinities, such as Western blot, ELISA, analytical ultracentrifugation, spectroscopy and surface plasmon resonance (Biacore®) analysis (see, e.g., Scatchard et al., Ann. N.Y. Acad. Sci. 51:660, 1949; Wilson, Science 295:2103, 2002; Wolff et al., Cancer Res. 53:2560, 1993; and U.S. Pat. Nos. 5,283,173, 5,468,614, or the equivalent).

In certain embodiments, a KRAS (or NRAS, or HRAS)-specific binding domain alone (i.e., without any other portion of a KRAS (or NRAS, or HRAS)-specific binding protein) can be soluble and can bind to KRAS (or NRAS, or HRAS) (or a KRAS (or NRAS, or HRAS) peptide, or a KRAS (or NRAS, or HRAS) peptide:HLA complex) with a $K_d$ of less than about $10^{-8}$ M, less than about $10^{-9}$ M, less than about $10^{-10}$ M, less than about $10^{-11}$ M, less than about $10^{-12}$ M, or less than about $10^{-13}$ M. In particular embodiments, a KRAS (or NRAS, or HRAS)-specific binding domain includes a KRAS (or NRAS, or HRAS)-specific scTCR (e.g., single chain αβTCR proteins such as Vα-L-Vβ, Vβ-L-Vα, Vα-Cα-L-Vα, or Vα-L-Vβ-Cβ, wherein Vα and Vβ are TCRα and β variable domains respectively, Cα and Cβ are TCRα and β constant domains, respectively, and L is a linker, such as a linker described herein).

The term "functional avidity", as used herein, refers to a biological measure or activation threshold of an in vitro immune cell (e.g., T cell, NK cell, NK-T cell) response to a given concentration of a ligand, wherein the biological measures can include cytokine production (e.g., IFN-γ production, IL-2 production, etc.), cytotoxic activity, activation markers (e.g., CD137, Nur77) and proliferation. For example, T cells that biologically (immunologically) respond in vitro to a low antigen dose by, for example, producing cytokines, exhibiting cytotoxic activity, or proliferating are considered to have high functional avidity, while T cells having lower functional avidity require higher amounts of antigen before an immune response, similar to the high-avidity T cells, is elicited. It will be understood that functional avidity is different from affinity and avidity. Affinity refers to the strength of any given bond between a binding protein and its antigen/ligand. Some binding proteins are multivalent and bind to multiple antigens—in this case, the strength of the overall connection is the avidity.

Numerous correlations exist between the functional avidity and the effectiveness of an immune response. Some ex vivo studies have shown that distinct T cell functions (e.g., proliferation, cytokines production, etc.) can be triggered at different thresholds (see, e.g., Betts et al., J. Immunol. 172:6407, 2004; Langenkamp et al., Eur. J. Immunol. 32:2046, 2002). Factors that affect functional avidity can include (a) the affinity of a TCR for the pMHC-complex, that is, the strength of the interaction between the TCR and pMHC (Cawthon et al., J. Immunol. 167:2577, 2001), (b) expression levels of the TCR, and, in some embodiments, CD4 or CD8 co receptors, on the host cell and (c) the distribution and composition of signaling molecules (Viola and Lanzavecchia, Science 273:104, 1996), as well as expression levels of molecules that attenuate T cell function and TCR signaling.

The concentration of antigen needed to induce a half-maximum response (e.g., production of a cytokine; fluorescence intensity when binding to a labeled peptide:HLA multimer) between the baseline and maximum response after a specified exposure time is referred to as the "half maximal effective concentration" or "EC50". The EC50 value is generally presented as a molar (moles/liter) amount, but it is often converted into a logarithmic value as follows—$\log_{10}$(EC50). For example, if the EC50 equals 1 μM ($10^{-6}$ M), the $\log_{10}$(EC50) value is −6. Another value used is pEC50, which is defined as the negative logarithm of the EC50 ($-\log_{10}$(EC50)). In the above example, the EC50 equaling 1 μM has a pEC50 value of 6. In certain embodiments, the functional avidity of a binding protein of this disclosure will comprise a measure of an ability of the binding protein to promote IFNγ production by T cells, which can be measured using assays known in the art and described herein. In certain embodiments, functional avidity will comprise a measure of the ability of the binding protein, upon binding to antigen, to activate a host cell, such as a T cell. In some contexts, "high functional avidity" TCRs or binding domains thereof refer to those TCRs or binding domains thereof having a EC50 of at least $10^{-4}$ M, at least about $10^{-5}$ M, or at least about $10^{-6}$ M, or at least about $10^{-7}$ M.

Also contemplated are fusion proteins comprising a scTCR of the present disclosure linked to the constant domain of an antibody (e.g., IgG (1, 2, 3, 4), IgE, IgD, IgA, IgM, and variants thereof) or a fragment thereof (e.g., a fragment that, in some embodiments, retains binding to one or more Fc receptors, to C1q, to Protein A, to Protein G, or any combination thereof), and including immunoglobulin heavy chain monomers and multimers, such as Fc dimers; see, e.g., Wong et al., *J. Immunol.* 198:1 Supp. (2017). Variant Fc polypeptides comprising mutations that enhance, reduce, or abrogate binding to or by, e.g., FcRn or other Fc receptors, are known and are contemplated within this disclosure.

In certain embodiments, a binding protein or fusion protein (e.g., TCR, scTCR, CAR) of the present disclosure is expressed by a host cell (e.g., by a T cell, NK cell, or NK-T cell heterologously expressing the binding protein or fusion protein). Avidity of such a host cell for a KRAS (or NRAS, or HRAS) peptide antigen or KRAS (or NRAS, or HRAS) peptide antigen:HLA complex can be determined by, for example, exposing the host cell to the peptide, or to a peptide:HLA complex (e.g., organized as a tetramer), or to an antigen-presenting cell (APC) that presents the peptide to the host cell, optionally in a peptide:HLA complex, and then measuring an activity of the host cell, such as, for example, production or secretion of cytokines (e.g., IFN-γ; TNFα); increased expression of host cell signaling or activation components (e.g., CD137 (4-1BB)); proliferation of the host cell; or killing of the APC (e.g., using a labeled-chromium release assay.

As used herein, "nucleic acid" or "nucleic acid molecule" or "polynucleotide" refers to any of deoxyribonucleic acid (DNA), ribonucleic acid (RNA), oligonucleotides, polynucleotides, fragments thereof generated, for example, by the polymerase chain reaction (PCR) or by in vitro translation, and also to fragments generated by any of ligation, scission, endonuclease action, or exonuclease action. In certain embodiments, the nucleic acids of the present disclosure are produced by PCR. Nucleic acids can be composed of monomers that are naturally occurring nucleotides (such as deoxyribonucleotides and ribonucleotides), analogs of naturally occurring nucleotides (e.g., α-enantiomeric forms of naturally occurring nucleotides), or a combination of both. Modified nucleotides can have modifications in or replacement of sugar moieties, or pyrimidine or purine base moieties. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, and the like. Nucleic acid molecules can be either single-stranded or double-stranded.

The term "isolated" means that the material is removed from its original environment (e.g., the natural environment if it is naturally occurring). For example, a naturally occurring nucleic acid or polypeptide present in a living animal is not isolated, but the same nucleic acid or polypeptide, separated from some or all of the co-existing materials in the natural system, is isolated. Such a nucleic acid could be part of a vector and/or such nucleic acid or polypeptide could be part of a composition (e.g., a cell lysate), and still be isolated in that such vector or composition is not part of the natural environment for the nucleic acid or polypeptide. The term "gene" means the segment of DNA involved in producing a polypeptide chain; it includes regions preceding and following the coding region ("leader and trailer") as well as intervening sequences (introns) between individual coding segments (exons).

As used herein, the terms "recombinant", "engineered", and "modified" refer to a cell, microorganism, nucleic acid molecule, polypeptide, protein, plasmid, or vector that has been modified by introduction of an exogenous nucleic acid molecule, or refers to a cell or microorganism that has been genetically engineered by human intervention—that is, modified by introduction of a heterologous nucleic acid molecule, or refers to a cell or microorganism that has been altered such that expression of an endogenous nucleic acid molecule or gene is controlled, deregulated or constitutive, where such alterations or modifications can be introduced by genetic engineering. Human-generated genetic alterations can include, for example, modifications introducing nucleic acid molecules (which may include an expression control element, such as a promoter) encoding one or more proteins or enzymes, or other nucleic acid molecule additions, deletions, substitutions, or other functional disruption of or addition to a cell's genetic material. Exemplary modifications include those in coding regions or functional fragments thereof of heterologous or homologous polypeptides from a reference or parent molecule.

As used herein, "mutation" refers to a change in the sequence of a nucleic acid molecule or polypeptide molecule as compared to a reference or wild-type nucleic acid molecule or polypeptide molecule, respectively. A mutation can result in several different types of change in sequence, including substitution, insertion or deletion of nucleotide(s) or amino acid(s). In certain embodiments, a mutation is a substitution of one or three codons or amino acids, a deletion of one to about 5 codons or amino acids, or a combination thereof.

A "conservative substitution" is recognized in the art as a substitution of one amino acid for another amino acid that has similar properties. Exemplary conservative substitutions are well known in the art (see, e.g., WO 97/09433 at page 10; Lehninger, Biochemistry, $2^{nd}$ Edition; Worth Publishers, Inc. NY, N.Y., pp. 71-77, 1975; Lewin, Genes IV, Oxford University Press, NY and Cell Press, Cambridge, Mass., p. 8, 1990).

In certain embodiments, proteins (e.g., binding protein, immunogenic peptide) according to the present disclosure comprise a variant sequence as compared to a reference sequence (e.g., a variant TCR CDR3β as compared to a reference TCR CDR3β disclosed herein). As used herein, a "variant" amino acid sequence, peptide, or polypeptide, refers to a an amino acid sequence (or peptide or polypeptide) having one or two amino acid substitutions, deletions, or insertions as compared to a reference amino acid sequence. In certain embodiments, a variant amino acid sequence, peptide, or polypeptide, retains substantially a same functionality (e.g., binding specificity and affinity for a peptide:HLA complex) as the reference molecule; for example, a variant TCR fragment as disclosed herein retains about 50%, about 60%, about 70%, about 80%, about 90%, about 95%, about 99%, or 100% of the antigen-binding specificity and affinity as compared to a reference TCR binding fragment.

An "altered domain" or "altered protein" refers to a motif, region, domain, peptide, polypeptide, or protein with a non-identical sequence identity to a wild type motif, region, domain, peptide, polypeptide, or protein (e.g., a wild type TCRα chain, TCRβ chain, TCRα constant domain, TCRβ constant domain) of at least 85% (e.g., 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9%).

Altered domains or altered proteins or derivatives can include those based on all possible codon choices for the same amino acid and codon choices based on conservative amino acid substitutions. For example, the following six groups each contain amino acids that are conservative substitutions for one another: 1) alanine (ala; A), serine (ser; S), threonine (thr; T); 2) aspartic acid (asp; D), glutamic acid (glu; E); 3) asparagine (asn; N), glutamine (gln; Q); 4) arginine (arg; R), lysine (lys; K); 5) Isoleucine (ile; I), leucine (L), methionine (met; M), valine (val; V); and 6) phenylalanine (phe; F), tyrosine (tyr; Y), tryptophan (trp; W). (See also WO97/09433 at page 10, Lehninger, Biochemistry, $2^{nd}$ Edition, Worth Publishers, Inc., NY, N.Y., pp. 71-77, 1975; Lewin Genes IV, Oxford University Press, NY and Cell Press, Cambridge, Mass., p. 8, 1990; Creighton, Proteins, W.H. Freeman and Company 1984). In addition, individual substitutions, deletions or additions that alter, add or delete, a single amino acid or a small percentage of amino acids in an encoded sequence are also "conservative substitutions."

The term "construct" refers to any polynucleotide that contains a recombinant nucleic acid molecule. A "transgene" or "transgene construct" refers to a construct that contains two or more genes operably linked in an arrangement that is not found in nature. The term "operably-linked" (or "operably linked" herein) refers to the association of two or more nucleic acid molecules on a single nucleic acid fragment so that the function of one is affected by the other. For example, a promoter is operably-linked with a coding sequence when it can affect the expression of that coding sequence (i.e., the coding sequence is under the transcriptional control of the promoter). "Unlinked" means that the associated genetic elements are not closely associated with one another and the function of one does not affect the other. In some embodiments, the genes present in a transgene are operably linked to an expression control sequence (e.g., a promoter).

A construct (e.g., a transgene) can be present in a vector (e.g., a bacterial vector, a viral vector) or can be integrated into a genome. A "vector" is a nucleic acid molecule that is capable of transporting another nucleic acid molecule. Vectors can be, for example, plasmids, cosmids, viruses, a RNA vector or a linear or circular DNA or RNA molecule that can include chromosomal, non-chromosomal, semi-synthetic or synthetic nucleic acid molecules. Exemplary vectors are those capable of autonomous replication (episomal vector) or expression of nucleic acid molecules to which they are linked (expression vectors). Vectors useful in the compostions and methods of this disclosure are described further herein.

The term "expression", as used herein, refers to the process by which a polypeptide is produced based on the encoding sequence of a nucleic acid molecule, such as a gene. The process can include transcription, post-transcriptional control, post-transcriptional modification, translation, post-translational control, post translational modification, or any combination thereof.

The term "introduced" in the context of inserting a nucleic acid molecule into a cell, means "transfection", or "transformation", or "transduction" and includes reference to the incorporation of a nucleic acid molecule into a eukaryotic or prokaryotic cell wherein the nucleic acid molecule can be incorporated into the genome of a cell (e.g., a chromosome, a plasmid, a plastid, or a mitochondrial DNA), converted into an autonomous replicon, or transiently expressed (e.g., transfected mRNA).

As used herein, "heterologous" or "exogenous" nucleic acid molecule, construct or sequence refers to a nucleic acid molecule or portion of a nucleic acid molecule that is not native to a host cell, but can be homologous to a nucleic acid molecule or portion of a nucleic acid molecule from the host cell. The source of the heterologous or exogenous nucleic acid molecule, construct or sequence can be from a different genus or species. In certain embodiments, a heterologous or exogenous nucleic acid molecule is added (i.e., not endogenous or native) to a host cell or host genome by, for example, conjugation, transformation, transfection, transduction, electroporation, or the like, wherein the added molecule can integrate into the host genome or exist as extra-chromosomal genetic material (e.g., as a plasmid or other form of self-replicating vector), and can be present in multiple copies. In addition, "heterologous" refers to a non-native enzyme, protein or other activity encoded by an exogenous nucleic acid molecule introduced into the host cell, even if the host cell encodes a homologous protein or activity. Moreover, a cell comprising a "modification" or a "heterologous" polynucleotide or binding protein includes progeny of that cell, regardless of whether the progeny were themselves transduced, transfected, or otherwise manipulated or changed.

As described herein, more than one heterologous or exogenous nucleic acid molecule can be introduced into a host cell as separate nucleic acid molecules, as a plurality of individually controlled genes, as a polycistronic nucleic acid molecule, as a single nucleic acid molecule encoding a fusion protein, or any combination thereof. For example, as disclosed herein, a host cell can be modified to express one or more heterologous or exogenous nucleic acid molecule encoding desired TCR specific for a Ras antigen peptide (e.g., TCRα and TCRβ) and optionally, as disclosed herein, also encoding a CD8 co-receptor polypeptide comprising a α chain, a β chain, or a portion thereof, such as an extra-cellular portion capable of binding to MEW. When two or more exogenous nucleic acid molecules are introduced into a host cell, it is understood that the two or more exogenous nucleic acid molecules can be introduced as a single nucleic acid molecule (e.g., on a single vector), on separate vectors, integrated into the host chromosome at a single site or multiple sites, or any combination thereof. The number of referenced heterologous nucleic acid molecules or protein activities refers to the number of encoding nucleic acid molecules or the number of protein activities, not the number of separate nucleic acid molecules introduced into a host cell.

As used herein, the term "endogenous" or "native" refers to a gene, protein, or activity that is normally present in a host cell. Moreover, a gene, protein or activity that is mutated, overexpressed, shuffled, duplicated or otherwise altered as compared to a parent gene, protein or activity is still considered to be endogenous or native to that particular host cell. For example, an endogenous control sequence from a first gene (e.g., a promoter, translational attenuation sequences) can be used to alter or regulate expression of a second native gene or nucleic acid molecule, wherein the expression or regulation of the second native gene or nucleic acid molecule differs from normal expression or regulation in a parent cell.

The term "homologous" or "homolog" refers to a molecule or activity found in or derived from a host cell, species or strain. For example, a heterologous or exogenous nucleic acid molecule can be homologous to a native host cell gene, and can optionally have an altered expression level, a different sequence, an altered activity, or any combination thereof.

"Sequence identity," as used herein, refers to the percentage of amino acid residues in one sequence that are identical with the amino acid residues in another reference polypeptide sequence after aligning the sequences and introducing gaps, if necessary, to achieve the maximum percent sequence identity, and not considering any conservative substitutions as part of the sequence identity. The percentage sequence identity values can be generated using the NCBI BLAST 2.0 software as defined by Altschul et al. (1997), *Nucl. Acids Res.* 25:3389-3402, with the parameters set to default values.

Binding Proteins

In one aspect, the present disclosure provides a binding protein, comprising a T cell receptor (TCR) α chain variable (Vα) domain and a TCR β chain variable (Vβ) domain, wherein the binding protein is capable of binding to a peptide:HLA complex, wherein the peptide comprises or consists of the amino acid sequence KLVVVGAVGV (SEQ ID NO:198). In certain embodiments, the HLA comprises an HLA-A*02, optionally HLA-A*02:01. In any of the presently disclosed embodiments, the binding protein can be heterologously expressed by a human immune system cell, such as, for example, a T cell.

In certain embodiments, the Vα domain and/or the Vβ domain are each independently human, humanized, or chimeric, and are preferably each human.

Presently disclosed binding proteins are capable of being heterologously expressed by host cells, such as, for example, human immune cells, such as T cells. Furthermore, expression of a presently disclosed binding protein can confer advantageous properties upon a host cell; e.g., having binding specificity for a Ras antigen:HLA complex of the present disclosure, improved activation, proliferation, or killing activity in the presence of a Ras antigen:HLA presenting tumor cell, or the like.

For example, in certain embodiments, when the binding protein is expressed by an immune cell (e.g., a human T cell, optionally a CD8+ and/or CD4+ T cell, a NK cell, or a NK-T cell), the immune cell is capable of specifically killing a HLA-A*02$^+$ tumor cell that expresses a peptide comprising or consisting of the amino acid sequence set forth in SEQ ID NO.:198. Killing of a target cell can be determined, for example, the Incucyte® bioimaging platform (Essen Bioscience). In certain embodiments, this platform uses activated caspase and labelled (e.g., RapidRed or NucRed) tumor cell signals, wherein overlap is measured and increased overlap area equals tumor cell death by apoptosis. Killing can also be determined using a 4-hour assay in which target cells are loaded with labeled chromium ($^{51}$Cr), and $^{51}$Cr in the supernatant is measured following 4-hour co-incubation with an immune cell expressing a binding protein of the present disclosure. In certain embodiments, a killing assay can be performed using an effector:target cell ratio of 1:1, 2:1, 3:1, 4:1, 5:1, 6:1, 7:1, 8:1, 9:1, 10:1, 20:1, 25:1, 50:1, or 100:1, or the like.

In any of the presently disclosed embodiments, when the binding protein is expressed by an immune cell (e.g., a human T cell, optionally a CD8+ and/or CD4+ T cell, a NK cell, or a NK-T cell), the immune cell has elevated expression of Nur77 when in the presence of a HLA-A*02$^+$ tumor cell that expresses a peptide comprising or consisting of the amino acid sequence set forth in SEQ ID NO.:198, optionally in the further presence of exogenous IFN-γ, wherein the Nur77 expression is elevated as compared to: (i) Nur77 expression by a reference immune cell (i.e., of the same cell type as, and otherwise phenotypically and/or genotypically at least substantially identical or functionally equivalent to, the immune cell expressing the binding protein) not expressing the binding protein, when the reference immune cell is in the presence of the tumor cell; and/or (ii) Nur77 expression by the immune cell expressing the binding protein when not in the presence of the tumor cell and/or when not in the presence of an antigen-presenting cell expressing a peptide:HLA complex, wherein the peptide comprises or consists of the amino acid sequence set forth in SEQ ID NO.:198, and wherein the HLA is optionally HLA-A*02:01. Expression of Nur77 can be determined, for example, using a transgenic expression construct comprising a Nur77 locus operably linked to a sequence encoding a reporter construct; e.g., dTomato (see Ahsouri and Weiss, *J Immunol* 198(2):657-668 (2017)).

In any of the presently disclosed embodiments, when the binding protein is expressed by an immune cell (e.g., a human T cell, optionally a CD8+ and/or CD4+ T cell, a NK cell, or a NK-T cell), the immune cell has elevated expression of CD137 (also known as 4-1BB) when in the presence of a HLA-A*02$^+$ tumor cell that expresses a peptide comprising or consisting of the amino acid sequence set forth in SEQ ID NO.:198, optionally in the further presence of exogenous IFN-γ, wherein the CD137 expression is elevated as compared to: (i) CD137 expression by a reference immune cell not expressing the binding protein, when the reference immune cell is in the presence of the tumor cell; and/or (ii) CD137 expression by the immune cell expressing the binding protein when not in the presence of the tumor cell and/or when not in the presence of an antigen-presenting cell expressing a peptide:HLA complex, wherein the peptide comprises or consists of the amino acid sequence set forth in SEQ ID NO.:198, and wherein the HLA is optionally HLA-A*02:01. CD137 expression can be determined using, for example, flow cytometry using a labeled anti-CD137 antibody. In certain embodiments, CD137 is measured following a 16-hour assay in which the immune cell is co-incubated with or stimulated with peptide or a target cell expressing the peptide.

In any of the presently disclosed embodiments, when the binding protein is expressed by an immune cell (e.g., a human T cell, optionally a CD8+ and/or CD4+ T cell, a NK cell, or a NK-T cell), the immune cell produces IFN-γ when in the presence of a peptide comprising or consisting of the amino acid sequence set forth in SEQ ID NO.:198, when the peptide is present at a concentration of at least about $10^{-10}$ M, at least about $10^{-9}$ M, and/or at least about $10^{-8}$ M. Production of IFN-γ can be determined by, for example, intracellular staining using a labeled anti-IFN-γ antibody following stimulation with a peptide antigen, peptide:HLA complex, or tumor cell as provided herein. Production of IFN-γ can be determined following a 4-hour assay in which the immune cell is co-incubated with or stimulated with peptide or a target cell expressing the peptide. In certain embodiments, of a plurality of immune cells (e.g., human T cells, NK cells, NK-T cell, or any combination thereof) expressing the binding protein, at least about 10%, at least about 15%, at least about 20%, or at least about 25% of the plurality of immune cells produce IFN-γ when in the presence of $10^{-9}$ M peptide.

In certain embodiments, of a plurality of immune cells (e.g., human T cells, optionally CD8+ and/or CD4+ T cells, NK cells, or NK-T cells) expressing the binding protein, at least about 25%, at least about 30%, or at least about 35% of the plurality of immune cells produce IFN-γ when in the presence of $10^{-8}$ M peptide. In certain embodiments, the immune cell or plurality of immune cells produce IFN-γ when in the presence of 0.1 ng/mL or more of the peptide comprising or consisting of the amino acid sequence KLVVVGAVGV (SEQ ID NO:198), wherein optionally, the immune cell or the plurality of immune cells produce more IFN-γ when in the presence of 1 ng/mL of the peptide comprising or consisting of the amino acid sequence KLVVVGAVGV (SEQ ID NO:198) than when in the presence of 10,000 ng/mL of a peptide comprising or consisting of amino acids 5-14 of SEQ ID NO.: 1.

In any of the presently disclosed embodiments, a binding protein has a $\log_{10}$ EC50 for the peptide comprising or consisting of the amino acid sequence set forth in SEQ ID NO.:198 of less than −8.0, optionally about −8.5 or less, further optionally about −8.5, about −8.6, about −8.7, about −8.8, about −8.9, about −9, about −9.1, or about −9.2.

In any of the presently disclosed embodiments: (i) the binding protein is encoded by a polynucleotide that is heterologous to the immune cell; (ii) the immune cell comprises a human CD8$^+$ T cell, a human CD4+ T cell, or both; (iii) the tumor cell expressing a peptide comprising or consisting of the amino acid sequence set forth in SEQ ID NO.:198 is HLA-A*02:01$^+$; and/or (iv) the tumor cell comprises a CFPAC-1 cell.

In any of the presently disclosed embodiments, the binding protein is capable of binding to the peptide:HLA complex independent of, or in the absence of, CD8. CD8-independent binding can be determined, for example, by flow cytometry to identify binding by a binding protein to a A2(DM)/-peptide multimer. This multimer is assembled from modified HLA-A*02:01 alpha-3 domain double-mutated (DM) monomers, which cannot bind to CD8. CD8-independent binding can also be determined by expressing the binding protein in a CD8-negative cell (e.g., a CD4$^+$ T cell, a Jurkat cell, or the like) and identifying binding of the cell to a target.

In certain embodiments: (i) the Vα domain comprises a CDR1a, a CDR2a, and/or a CDR3α amino acid sequence according to the Vα amino acid sequence set forth in any one of SEQ ID NOs.: 351, 343, 359, 367, 375, 383, 391, 399, 407, 415, 423, 431, 439, 447, 455, 463, 471, or 479; and/or (ii) the Vβ domain comprises a CDR1β, a CDR2β, and/or a CDR3β amino acid sequence according to the Vβ amino acid sequence set forth in any one of SEQ ID NOs.: 354, 346, 362, 370, 378, 386, 394, 402, 410, 418, 426, 434, 442, 450, 458, 466, 474, 482, or 490. In certain embodiments, CDRs are determined using the IMGT, EU, Kabat, Chothia, Aho, or Enhanced Chothia numbering scheme. TCR variable domain sequences can be aligned to a numbering scheme (e.g., Kabat, Chothia, EU, IMGT, Enhanced Chothia, and Aho), allowing equivalent residue positions to be annotated and for different molecules to be compared using, for example, ANARCI software tool (2016, Bioinformatics 15:298-300).

In further embodiments, the binding protein comprises CDR1α, CDR2α, CDR3α and CDR1β, CDR2β, and CDR3β amino acid sequences according to the Vα and Vβ amino acid sequences set forth in: (i) SEQ ID NOs.: 351 and 354, respectively; (ii) SEQ ID NOs.: 343 and 346, respectively; (iii) SEQ ID NOs.: 359 and 362, respectively; (iv) SEQ ID NOs.: 367 and 370, respectively; (v) SEQ ID NOs.: 375 and 378, respectively; (vi) SEQ ID NOs.: 383 and 386, respectively; (vii) SEQ ID NOs.: 391 and 394, respectively; (viii) SEQ ID NOs.: 399 and 402, respectively; (ix) SEQ ID NOs.: 407 and 410, respectively; (x) SEQ ID NOs.: 415 and 418, respectively; (xi) SEQ ID NOs.: 423 and 426, respectively; (xii) SEQ ID NOs.: 431 and 434, respectively; (xiii) SEQ ID NOs.: 439 and 442, respectively; (xiv) SEQ ID NOs.: 447 and 450, respectively; (xv) SEQ ID NOs.: 455 and 458, respectively; (xvi) SEQ ID NOs.: 463 and 466, respectively; (xvii) SEQ ID NOs.: 471 and 474, respectively; (xviii) SEQ ID NOs.: 479 and 482, respectively; or (xix) SEQ ID NOs.: 487 and 490, respectively.

In certain embodiments, a binding protein of the present disclosure comprises: (i) the CDR3α amino acid sequence set forth in any one of SEQ ID NOs.: 228, 222, 234, 240, 246, 252, 258, 264, 270, 276, 282, 288, 294, 300, 306, 312, 318, 324, or 340, or a variant thereof comprising one, two, or three amino acid substitutions, any or all of which can comprise a conservative amino acid substitution; and/or (ii) the CDR3β amino acid sequence set forth in any one of SEQ ID NOs.: 225, 219, 231, 237, 243, 249, 255, 261, 267, 273, 279, 285, 291, 297, 303, 309, 315, 321, or 327, or a variant thereof comprising one, two, or three amino acid substitutions, any or all of which can comprise a conservative amino acid substitution; and/or (iii) the CDR1α amino acid sequence set forth in any one of SEQ ID NOs.: 226, 220, 232, 238, 244, 250, 256, 262, 268, 274, 280, 286, 292, 298, 304, 310, 316, 322, or 328, or a variant thereof comprising one, two, or three amino acid substitutions, any or all of which can comprise a conservative amino acid substitution; and/or (iv) the CDR1β amino acid sequence set forth in any one of SEQ ID NOs.: 223, 217, 229, 235, 241, 247, 253, 259, 265, 271, 277, 283, 289, 295, 301, 307, 313, 319, or 325, or a variant thereof comprising one, two, or three amino acid substitutions, any or all of which can comprise a conservative amino acid substitution; and/or (v) the CDR2α amino acid sequence set forth in any one of SEQ ID NOs.: 227, 221, 233, 239, 245, 251, 257, 263, 269, 275, 281, 287, 293, 299, 305, 311, 317, 323, or 329, or a variant thereof comprising one, two, or three amino acid substitutions, any or all of which can comprise a conservative amino acid substitution; and/or (vi) the CDR2β amino acid sequence set forth in any one of SEQ ID NOs.: 224, 218, 230, 236, 242, 248, 254, 260, 266, 272, 278, 284, 290, 296, 302, 308, 314, 320, or 326, or a variant thereof comprising one, two, or three amino acid substitutions, any or all of which can comprise a conservative amino acid substitution.

In further embodiments, a binding protein of the present disclosure comprises the CDR1α, CDR2α, CDR3α, CDR1β, CDR2β, and CDR3β amino acid sequences set forth in: (i) SEQ ID NOs.: 226, 227, 228, 223, 224, and 225, respectively; (ii) SEQ ID NOs.: 220, 221, 222, 217, 218, and 219, respectively; (iii) SEQ ID NOs.: 232, 233, 234, 229, 230, and 231, respectively; (iv) SEQ ID NOs.: 238, 239, 240, 235, 236, and 237, respectively; (v) SEQ ID NOs.: 244, 245, 246, 241, 242, and 243, respectively; (vi) SEQ ID NOs.: 250, 251, 252, 247, 248, and 249, respectively; (vii) SEQ ID NOs.: 256, 257, 258, 253, 254, and 255, respectively; (viii) SEQ ID NOs.: 262, 263, 264, 259, 260, and 261, respectively; (ix) SEQ ID NOs.: 268, 269, 270, 265, 266, and 267, respectively; (x) SEQ ID NOs.: 274, 275, 276, 271, 272, and 273, respectively; (xi) SEQ ID NOs.: 280, 281, 282, 277, 278, and 279, respectively; (xii) SEQ ID NOs.: 286, 287, 288, 283, 284, and 285, respectively; (xiii) SEQ ID NOs.: 292, 293, 294, 289, 290, and 291, respectively; (xiv) SEQ ID NOs.: 298, 299, 300, 295, 296, and 297, respectively; (xv) SEQ ID NOs.: 304, 305, 306, 301, 302, and 303, respectively; (xvi) SEQ ID NOs.: 310, 311, 312, 307, 308, and 309, respectively; (xvii) SEQ ID NOs.: 316, 317, 318, 313, 314, and 315, respectively; (xviii) SEQ ID NOs.: 322, 323, 324, 319, 320, and 321, respectively; or (xix) SEQ ID NOs.: 328, 329, 330, 325, 326, and 327, respectively.

In any of the presently disclosed embodiments, the binding protein can comprise a Vβ domain and/or a Vα domain having at least 90% identity to the Vβ domain or the Vα domain, respectively, from D_2_1.1, D_2_1.2, D_2_1.3, D_2_1.4, D_2_1.5, D_2_1.6, D_2_1.7, D_2_1.8, D_2_1.9, D_2_1.10, D_2_2.1, D_2_2.2, D_2_2.3, D_2_2.4, D_2_2.5, D_2_2.6, D_2_2.7, D_2_2.8, D_2_2.9, or D_2_2.10 provided that: (a) at least three or four of the CDRs have no mutations; (b) the CDRs that do have mutations have only up to two amino acid substitutions, up to a contiguous five amino acid deletion, or a combination thereof; and (c) the encoded binding protein retains its ability to bind to a peptide:HLA-A*02:01 complex comprising a KRAS peptide according to any one of SEQ ID NOs:198-201. In further embodiments, the binding domain comprises: (i) a CDR3β from D_2_1.1, D_2_1.2, D_2_1.3, D_2_1.4, D_2_1.5, D_2_1.6, D_2_1.7, D_2_1.8, D_2_1.9, D_2_1.10, D_2_2.1, D_2_2.2, D_2_2.3, D_2_2.4, D_2_2.5, D_2_2.6, D_2_2.7, D_2_2.8, D_2_2.9, or D_2_2.10; and/or (ii) a CDR3α from D_2_1.1, D_2_1.2, D_2_1.3, D_2_1.4, D_2_1.5, D_2_1.6, D_2_1.7, D_2_1.8, D_2_1.9, D_2_1.10, D_2_2.1, D_2_2.2, D_2_2.3, D_2_2.4, D_2_2.5, D_2_2.6, D_2_2.7, D_2_2.8, D_2_2.9, or D_2_2.10. In some embodiments, the binding domain comprises a CDR1β, and CDR2β, a CDR1α, and/or a CDR2α from D_2_1.1, D_2_1.2, D_2_1.3, D_2_1.4, D_2_1.5, D_2_1.6, D_2_1.7, D_2_1.8, D_2_1.9, D_2_1.10, D_2_2.1, D_2_2.2, D_2_2.3, D_2_2.4, D_2_2.5, D_2_2.6, D_2_2.7, D_2_2.8, D_2_2.9, or D_2_2.10.

In particular embodiments, the binding domain comprises a Vβ domain and a Vα domain from D_2_1.1, D_2_1.2, D_2_1.3, D_2_1.4, D_2_1.5, D_2_1.6, D_2_1.7, D_2_1.8, D_2_1.9, D_2_1.10, D_2_2.1, D_2_2.2, D_2_2.3, D_2_2.4, D_2_2.5, D_2_2.6, D_2_2.7, D_2_2.8, D_2_2.9, or D_2_2.10.

In any of the presently disclosed embodiments: (i) the Vα domain can comprise or consist of an amino acid sequence having at least 90% (i.e., 90%, 91%, 92%, 93%, 94%, 95%, 96%, 97%, 98%, 99%, 99.5%, or 100%) identity to the amino acid sequence set forth in any one of SEQ ID NOs.: 351, 343, 359, 367, 375, 383, 391, 399, 407, 415, 423, 431, 439, 447, 455, 463, 471, or 479; and/or (ii) the Vβ domain comprises or consists of an amino acid sequence having at least 90% (i.e., 90%, 91%, 92%, 93%, 94%, 95%, 96%, 97%, 98%, 99%, 99.5%, or 100%) identity to the amino acid sequence set forth in any one of SEQ ID NOs.: 354, 346, 362, 370, 378, 386, 394, 402, 410, 418, 426, 434, 442, 450, 458, 466, 474, 482, or 490. In certain embodiments, variation as compared to a reference variable domain amino acid sequence provided herein is limited to one or more of the framework sequences, and optionally comprises or consists of one or more conservative substitutions.

In particular embodiments, the Vα domain and the Vβ domain comprise or consist of the amino acid sequences set forth in: (i) SEQ ID NOs.: 351 and 354, respectively; (ii) SEQ ID NOs.: 343 and 346, respectively; (iii) SEQ ID NOs.: 359 and 362, respectively; (iv) SEQ ID NOs.: 367 and 370, respectively; (v) SEQ ID NOs.: 375 and 378, respectively; (vi) SEQ ID NOs.: 383 and 386, respectively; (vii) SEQ ID NOs.: 391 and 394, respectively; (viii) SEQ ID NOs.: 399 and 402, respectively; (ix) SEQ ID NOs.: 407 and 410, respectively; (x) SEQ ID NOs.: 415 and 418, respectively; (xi) SEQ ID NOs.: 423 and 426, respectively; (xii) SEQ ID NOs.: 431 and 434, respectively; (xiii) SEQ ID NOs.: 439 and 442, respectively; (xiv) SEQ ID NOs.: 447 and 450, respectively; (xv) SEQ ID NOs.: 455 and 458, respectively; (xvi) SEQ ID NOs.: 463 and 466, respectively; (xvii) SEQ ID NOs.: 471 and 474, respectively; (xviii) SEQ ID NOs.: 479 and 482, respectively; or (xix) SEQ ID NOs.: 487 and 490, respectively.

In any of the presently disclosed embodiments, a binding protein can further comprise a TCR α chain constant domain (Cα) and/or a TCR β chain constant domain (Cβ). In certain embodiments, the Cα comprises or consists of an amino acid sequence having at least 90% (i.e., 90%, 91%, 92%, 93%, 94%, 95%, 96%, 97%, 98%, 99%, 99.5%, or 100%) identity to the amino acid sequence set forth in SEQ ID NO.:85 or 86. In certain embodiments, the Cβ comprises or consists of an amino acid sequence having at least 90% identity to the amino acid sequence set forth in any one of SEQ ID NOs.: 87-99.

In some embodiments, a binding protein comprises a TCR α chain and a TCR β chain, wherein the TCR α chain and a TCR β chain comprise or consist of an amino acid sequence having at least 90% identity to the amino acid sequence set forth in: (i) SEQ ID NOs.: 350 and 353, respectively; (ii) SEQ ID NOs.: 342 and 345, respectively; (iii) SEQ ID NOs.: 358 and 361, respectively; (iv) SEQ ID NOs.: 366 and 369, respectively; (v) SEQ ID NOs.: 374 and 377, respectively; (vi) SEQ ID NOs.: 382 and 385, respectively; (vii) SEQ ID NOs.: 390 and 393, respectively; (viii) SEQ ID NOs.: 398 and 401, respectively; (ix) SEQ ID NOs.: 406 and 409, respectively; (x) SEQ ID NOs.: 414 and 417, respectively; (xi) SEQ ID NOs.: 422 and 425, respectively; (xii) SEQ ID NOs.: 430 and 433, respectively; (xiii) SEQ ID NOs.: 438 and 441, respectively; (xiv) SEQ ID NOs.: 446 and 449, respectively; (xv) SEQ ID NOs.: 454 and 457, respectively; (xvi) SEQ ID NOs.: 462 and 465, respectively; (xvii) SEQ ID NOs.: 470 and 473, respectively; (xviii) SEQ ID NOs.: 478 and 481, respectively; or (xix) SEQ ID NOs.: 486 and 489, respectively.

In any of the presently disclosed embodiments, a binding protein can comprise a TCR, a single-chain TCR (scTCR), or a chimeric antigen receptor (CAR). Methods for producing engineered TCRs are described in, for example, Bowerman et al., *Mol. Immunol.*, 46(15):3000 (2009), the techniques of which are herein incorporated by reference. Methods for making CARs are known in the art and are described, for example, in U.S. Pat. Nos. 6,410,319; 7,446,191; U.S. Patent Publication No. 2010/065818; U.S. Pat. No. 8,822,647; PCT Publication No. WO 2014/031687; U.S. Pat. No. 7,514,537; and Brentjens et al., 2007, *Clin. Cancer Res.* 13:5426, the techniques of which are herein incorporated by reference.

In another aspect, binding proteins are provided that comprise a T cell receptor (TCR) α chain variable (Vα) domain and a TCR β chain variable (Vβ) domain, wherein the binding protein is capable of binding to any one or more of: (i) a peptide:HLA complex, wherein the peptide comprises or consists of the amino acid sequence VVVGAVGVGK (SEQ ID NO:2); (ii) a peptide:HLA complex, wherein the peptide comprises or consists of the amino acid sequence VVGAVGVGK (SEQ ID NO:3); (iii) a peptide:HLA complex, wherein the peptide comprises or consists of the amino acid sequence VVGADGVGK (SEQ ID NO:4); or (iv) a peptide:HLA complex, wherein the peptide comprises or consists of the amino acid sequence VVVGADGVGK (SEQ ID NO:5).

In certain embodiments, the Vα domain and/or the Vβ domain are each independently human, humanized, or chimeric, and are preferably each human.

In any of the presently disclosed embodiments, the binding protein can be heterologously expressed by an immune cell (e.g., T cell, NK cell, NK-T cell, or the like). In certain embodiments, the immune cell comprises a human T cell.

In certain embodiments, the HLA comprises an HLA-A*11, optionally HLA-A*11:01.

In any of the presently disclosed embodiments, when the binding protein is expressed by an immune cell (e.g., T cell, such as a human CD8+ and/or CD4+ T cell, a NK cell, a NK-T cell, or the like), the immune cell is capable of specifically (e.g., only, or preferentially) killing a HLA-A*11+ tumor cell that expresses or displays on its cell surface a peptide comprising or consisting of the amino acid sequence set forth in any one or more of SEQ ID NOs.: 2-5, wherein, optionally, the expressed binding protein is encoded by a polynucleotide that is heterologous to the immune cell. In any of the presently disclosed embodiments, the tumor cell comprises a Panc-1 cell, an AsPc-1 cell, a CFPAC-1 cell, a Capan-2 cell, a THP-1 cell, a 721.221 cell, a GA-10.4 cell, or any combination thereof. Killing of a target cell can be determined, for example, the Incucyte® bioimaging platform (Essen Bioscience). In certain embodiments, this platform uses activated caspase and labelled (e.g., RapidRed or NucRed) tumor cell signals, wherein overlap is measured and increased overlap area equals tumor cell death by apoptosis. Killing can also be determined using a 4-hour assay in which target cells are loaded with labeled chromium ($^{51}$Cr), and free $^{51}$Cr in the supernatant is measured following 4-hour co-incubation with an immune cell expressing a binding protein of the present disclosure. In certain embodiments, a killing assay can be performed at an effector:target cell ratio of 1:1, 2:1, 3:1, 4:1, 5:1, 6:1, 7:1, 8:1, 9:1, 10:1, 20:1, 25:1, 50:1, or 100:1, or the like.

In any of the presently disclosed embodiments, when the binding protein is expressed by an immune cell (e.g., T cell, NK cell, NK-T cell, or the like), the immune cell has elevated expression of Nur77 and/or CD137 when in the presence of: (i) a peptide comprising or consisting of the amino acid sequence set forth SEQ ID NO.: 2; (ii) a peptide comprising or consisting of the amino acid sequence set forth SEQ ID NO.: 3; (iii) a peptide comprising or consisting of the amino acid sequence set forth SEQ ID NO.: 4; (iv) a peptide comprising or consisting of the amino acid sequence set forth SEQ ID NO.: 5; (v) a peptide comprising or consisting of the amino acid sequence set forth SEQ ID NO.: 2 and a peptide comprising or consisting of the amino acid sequence set forth in SEQ ID NO.: 3; and/or (vi) a peptide comprising or consisting of the amino acid sequence set forth SEQ ID NO.: 4 and a peptide comprising or consisting of the amino acid sequence set forth in SEQ ID NO.: 5, wherein the Nur77 and/or CD137 expression is elevated as compared to Nur77 and/or CD137 expression by a reference immune cell not expressing the binding protein when the reference immune cell is in the presence of the peptide, and/or as compared to Nur77 and/or CD137 expression by the human T cell expressing the binding protein, when in the presence of a peptide comprising or consisting of the amino acid sequence set forth in SEQ ID NO.:2 or SEQ ID NO.:3, and wherein the peptide of any one of (i)-(vi) is optionally expressed by a tumor cell in the presence of the immune cell.

In any of the presently disclosed embodiments, a binding protein has (i) a $\log_{10}$ EC50 for the peptide comprising or consisting of the amino acid sequence set forth in SEQ ID NO.:2 or 3 of less than −6.5, optionally about −7.0, about −7.5 or about −8.0 or less than −8.0, optionally about −8.0, about −8.1, about −8.2, about −8.3, about −8.4, about −8.5; and/or (ii) a $\log_{10}$ EC50 for the peptide comprising or consisting of the amino acid sequence set forth in SEQ ID NO.:4 or 5 of less than −7.0 or less than −8.0, optionally about −7.5, about −7.6, about −7.7, about −7.8, about −8.0, about −8.1, about −8.2, about −8.3, about −8.4, about −8.5, about −8.6, about −8.7, about −8.8, or about −8.9.

In any of the presently disclosed embodiments, when the binding protein is expressed by an immune cell (e.g., T cell, NK cell, NK-T cell, or the like), the immune cell produces IFN-γ when in the presence of: (i) a peptide comprising or consisting of the amino acid sequence set forth in SEQ ID NO.: 2; and/or (ii) a peptide comprising or consisting of the amino acid sequence set forth in SEQ ID NO.: 3; and/or (iii) a peptide comprising or consisting of the amino acid sequence set forth in SEQ ID NO.: 4; and/or (v) a peptide comprising or consisting of the amino acid sequence set forth in SEQ ID NO.: 5, when the peptide is present at a concentration of at least about $10^{-11}$ M, at least about $10^{-10}$ M, at least about $10^{-9}$ M, and/or at least about $10^{-8}$ M.

In certain embodiments, of a plurality of immune cells (e.g., T cells, NK cells, NK-T cells, or the like) expressing the binding protein, at least about 50%, at least about 55%, at least about 60%, or more of the plurality of human T cells produce IFN-γ when in the presence of $10^{-8}$ M peptide, $10^{-7}$ M peptide, or $10^{-6}$ M peptide. In further embodiments, of a plurality of immune cells expressing the binding protein: (i) at least about 10%, 15%, 20%, or 25% of the plurality of immune cells produce IFN-γ when in the presence of 10 ng/mL of a peptide comprising or consisting of the amino acid sequence set forth in SEQ ID NO.: 4; (ii) at least about 25% of the plurality of immune cells produce IFN-γ when in the presence of 100 ng/mL of a peptide comprising or consisting of the amino acid sequence set forth in SEQ ID NO.:4; (iii) at least about 10%, 15%, 20%, or 25% of the plurality of immune cells produce IFN-γ when in the presence of 10 ng/mL of a peptide comprising or consisting of the amino acid sequence set forth in SEQ ID NO.: 3; and/or (iv) at least about 50%, at least about 55%, at least about 60%, at least about 65%, at least about 70% or at least about 75% of the plurality of immune cells produce IFN-γ when in the presence of 100 ng/mL of a peptide comprising or consisting of the amino acid sequence set forth in SEQ ID NO.: 3.

In any of the presently disclosed embodiments, when the binding protein is expressed by an immune cell (e.g., T cell, NK cell, or NK-T cell), the immune cell does not produce, or does not substantially produce, IFN-γ when in the presence of a peptide comprising or consisting of amino acids 7-16 or 8-16 of SEQ ID NO.:1.

In any of the presently disclosed embodiments, (i) the Vα domain can comprise a CDR1α, a CDR2α, and/or a CDR3α amino acid sequence according to the Vα amino acid sequence set forth in any one of SEQ ID NOs.: 76, 62, 64, 68, 70, 72, 74, 78, 80, 82, 84, 502, 512, 522, 532, 542, 552, 562, 572, 582, 592, 602, or 612; and/or (ii) the Vβ domain can comprise a CDR1β, a CDR2β, and/or a CDR3β amino acid sequence according to the Vβ amino acid sequence set forth in any one of SEQ ID NOs.: 75, 61, 63, 65, 67, 69, 71, 73, 77, 79, 81, 83, 501, 511, 521, 531, 541, 551, 561, 571, 581, 591, 601, or 611. TCR variable domain sequences can be aligned to a numbering scheme (e.g., Kabat, Chothia, EU, IMGT, Enhanced Chothia, and Aho), allowing equivalent residue positions to be annotated and for different molecules to be compared using, for example, ANARCI software tool (2016, Bioinformatics 15:298-300).

In certain embodiments, a binding protein can comprise CDR1α, CDR2α, CDR3α and CDR1β, CDR2β, and CDR3β amino acid sequences according to the Vα and Vβ amino acid sequences set forth in: (i) SEQ ID NOs.: 76 and 75, respectively; (ii) SEQ ID NOs.: 62 and 61, respectively; (iii) SEQ ID NOs.: 64 and 63, respectively; (iv) SEQ ID NOs.: 66 and 65, respectively; (v) SEQ ID NOs.: 68 and 67, respectively; (vi) SEQ ID NOs.: 70 and 69, respectively; (vii) SEQ ID NOs.: 72 and 71, respectively; (viii) SEQ ID NOs.: 74 and 73, respectively; (ix) SEQ ID NOs.: 78 and 77, respectively; (x) SEQ ID NOs.: 80 and 79, respectively; (xi) SEQ ID NOs.: 82 and 81, respectively; (xii) SEQ ID NOs.:

84 and 83, respectively; (xiii) SEQ ID NOs.: 522 and 521, respectively; (xiv) SEQ ID NOs.: 532 and 531, respectively; (xv) SEQ ID NOs.: 542 and 541, respectively; (xvi) SEQ ID NOs.: 552 and 551, respectively; (xvii) SEQ ID NOs.: 562 and 561, respectively; (xviii) SEQ ID NOs.: 572 and 571, respectively; (xix) SEQ ID NOs.: 582 and 581, respectively; (xx) SEQ ID NOs.: 592 and 591, respectively; (xxi) SEQ ID NOs.:602 and 601, respectively; (xxii) SEQ ID NOs.: 612 and 611, respectively; (xxiii) SEQ ID NOs.: 502 and 501, respectively; (xxiv) SEQ ID NOs.: 512 and 511, respectively;

In particular embodiments, a binding protein comprises: (i) the CDR3α amino acid sequence set forth in any one of SEQ ID NOs.: 660, 27, 10, 618, 12, 624, 14, 15, 630, 19, 17, 636, 21, 642, 23, 648, 25, 654, 29, 666, 31, 672, 33, 678, 35, 684, 495, 505, 515, 525, 535, 545, 555, 565, 575, 585, 595, or 605, or a variant thereof comprising one, two, or three amino acid substitutions, any or all of which can comprise a conservative amino acid substitution; and/or (ii) the CDR3β amino acid sequence set forth in any one of SEQ ID NOs.: 659, 26, 9, 617, 11, 623, 13, 629, 18, 16, 635, 20, 641, 22, 647, 24, 653, 26, 659, 28, 665, 30, 671, 32, 677, 498, 508, 518, 528, 538, 548, 558, 568, 578, 588, 598, or 608, or a variant thereof comprising one, two, or three amino acid substitutions, any or all of which can comprise a conservative amino acid substitution; and/or (iii) the CDR1α amino acid sequence set forth in any one of SEQ ID NOs.: 656, 614, 620, 626, 632, 638, 644, 650, 656, 662, 668, 674, 680, 493, 503, 513, 523, 533, 543, 553, 563, 573, 583, 593, 603, or a variant thereof comprising one, two, or three amino acid substitutions, any or all of which can comprise a conservative amino acid substitution; and/or (iv) the CDR1β amino acid sequence set forth in any one of SEQ ID NOs.: 655, 613, 619, 625, 631, 637, 643, 649, 661, 667, 673, 679, 496, 506, 516, 526, 536, 546, 556, 566, 576, 586, 596, or 606, or a variant thereof comprising one, two, or three amino acid substitutions, any or all of which can comprise a conservative amino acid substitution; and/or (v) the CDR2α amino acid sequence set forth in any one of SEQ ID NOs.: 658, 616, 622, 628, 634, 640, 646, 652, 664, 670, 676, 682, 494, 504, 514, 524, 534, 544, 554, 564, 574, 584, 594, or 604, or a variant thereof comprising one, two, or three amino acid substitutions, any or all of which can comprise a conservative amino acid substitution; and/or (vi) the CDR2β amino acid sequence set forth in any one of SEQ ID NOs.: 657, 615, 621, 627, 633, 639, 645, 651, 657, 663, 669, 675, 681, 497, 507, 517, 527, 537, 547, 557, 567, 587, 597, or 607, or a variant thereof comprising one, two, or three amino acid substitutions, any or all of which can comprise a conservative amino acid substitution.

In some embodiments, a binding protein comprises (a) the CDR3α amino acid sequence according to any one of SEQ ID NOs:19, 35, 10, 12, 14, 15, 17, 21, 23, 25, 27, 29, 31, or 33, or a variant thereof; (b) the CDR3β amino acid sequence according to any one of SEQ ID NOs:18, 34, 9, 11, 13, 16, 18, 20, 22, 24, 26, 28, 30, or 32, or a variant thereof; or (c) (a) and (b). In some embodiments, a binding protein comprises (a) a T cell receptor (TCR) a chain variable (Vα) domain comprising the CDR3 amino acid sequence (CDR3α) according to any one of SEQ ID NOs:19, 35, 10, 12, 14, 15, 17, 21, 23, 25, 27, 29, 31, or 33, or a variant thereof, and a TCR Vβ domain; or (b) a TCR Vβ domain comprising the CDR3 amino acid sequence (CDR3β) according to any one of SEQ ID NOs:18, 34, 9, 11, 13, 16, 18, 20, 22, 24, 26, 28, 30, or 32, or a variant thereof, and a TCR Vα domain; or (c) a TCR Vα domain of (a), and a TCR Vβ domain of (b), wherein the encoded binding protein is capable of specifically binding to a KRAS peptide:HLA complex, wherein the KRAS peptide comprises or consists of (i) the amino acid sequence VVVGAVGVGK (SEQ ID NO:2); or (ii) the amino acid sequence VVGAVGVGK (SEQ ID NO:3); or (iii) the amino acid sequence VVGADGVGK (SEQ ID NO:4); or (viii) the amino acid sequence VVVGADGVGK (SEQ ID NO:5).

In further embodiments, a binding protein comprises the CDR1α, CDR2α, CDR3α, CDR1β, CDR2β, and CDR3β amino acid sequences set forth in: (i) SEQ ID NOs.: 656, 658, 660 or 27, 655, 657, and 659 or 26, respectively; (ii) SEQ ID NOs.: 614, 616, 618 or 10, 613, 615, and 617 or 9, respectively; (iii) SEQ ID NOs.: 620, 622, 624 or 12, 619, 621, and 629 or 13, respectively; (iv) SEQ ID NOs.: 626, 628, 630 or 14 or 15, 625, 627, and 629 or 13, respectively; (v) SEQ ID NOs.: 632, 634, 636 or 17 or 19, 631, 633, and 635 or 18 or 16, respectively; (vi) SEQ ID NOs.: 638, 640, 642 or 21 or 17, 637, 639, and 641 or 20 or 16, respectively; (vii) SEQ ID NOs.: 644, 646, 648 or 23, 643, 645, and 647 or 22, respectively; (viii) SEQ ID NOs.: 650, 652, 654 or 25, 649, 651, and 653 or 24, respectively; (ix) SEQ ID NOs.: 662, 664, 666 or 29, 661, 663, and 665 or 28, respectively; (x) SEQ ID NOs.: 668, 670, 672 or 31, 667, 669, and 671 or 30, respectively; (xi) SEQ ID NOs.: 674, 676, 678 or 33, 673, 675, and 677 or 32, respectively; (xii) SEQ ID NOs.: 680, 682, 684 or 35, 679, 681, and 683 or 34, respectively; (xii) SEQ ID NOs.: 493-498, respectively; (xiv) SEQ ID NOs.: 503-508, respectively; (xv) SEQ ID NOs.: 513-518, respectively; (xvi) SEQ ID NOs.: 523-528, respectively; (xvii) SEQ ID NOs.: 533-538, respectively; (xviii) SEQ ID NOs.: 543-548, respectively; (xix) SEQ ID NOs.: 553-558, respectively; (xx) SEQ ID NOs.: 563-568, respectively; (xxi) SEQ ID NOs.: 573-578, respectively; (xxii) SEQ ID NOs.: 583-588, respectively; (xxiii) SEQ ID NOs.: 593-598, respectively; or (xxiv) SEQ ID NOs.: 603-608, respectively.

In certain embodiments, (i) the Vα domain of a binding protein comprises or consists of an amino acid sequence having at least 90% (i.e., 90%, 91%, 92%, 93%, 94%, 95%, 96%, 97%, 98%, 99%, 99.5%, or 100%) identity to the amino acid sequence set forth in any one of SEQ ID NOs.: 76, 62, 64, 68, 70, 72, 74, 78, 80, 82, 84, 502, 512, 522, 532, 542, 552, 562, 572, 582, 592, 602, or 612; and/or (ii) the Vβ domain comprises or consists of an amino acid sequence having at least 90% identity to the amino acid sequence set forth in any one of SEQ ID NOs.: 75, 61, 63, 65, 67, 69, 71, 73, 77, 79, 81, 83, 501, 511, 521, 531, 541, 551, 561, 571, 581, 591, 601, or 611. In certain embodiments, variation as compared to a reference variable domain amino acid sequence provided herein is limited to one or more of the framework sequences, and optionally comprises or consists of one or more conservative substitutions. In certain embodiments, a binding protein comprises an amino acid sequence having at least 90% identity to the amino acid sequence encoded by any one of the TRBV, TRBD, TRBJ, or TRAJ gene segments provided in Table 1 herein. The amino acid sequences encoded by these gene segments are known and can be accessed using, for example, the IMGT database (imgt.org). In certain embodiments, (i) at least three or four of the CDRs have no mutations; (ii) the CDRs that do have mutations have only up to two amino acid substitutions, up to a contiguous five amino acid deletion, or a combination thereof; and (iii) the encoded binding protein retains its ability to bind to a peptide:HLA-complex comprising a KRAS peptide according to any one of SEQ ID NOs:2-5.

In particular embodiments, the Vα domain and the Vβ domain comprise or consist of the amino acid sequences set forth in: (i) SEQ ID NOs.: 76 and 75, respectively; (ii) SEQ ID NOs.: 62 and 61, respectively; (iii) SEQ ID NOs.: 64 and 63, respectively; (iv) SEQ ID NOs.: 66 and 65, respectively; (v) SEQ ID NOs.: 68 and 67, respectively; (vi) SEQ ID NOs.: 70 and 69, respectively; (vii) SEQ ID NOs.: 72 and 71, respectively; (viii) SEQ ID NOs.: 74 and 73, respectively; (ix) SEQ ID NOs.: 78 and 77, respectively; (x) SEQ ID NOs.: 80 and 79, respectively; (xi) SEQ ID NOs.: 82 and 81, respectively; (xii) SEQ ID NOs.: 84 and 83, respectively; (xiii) SEQ ID NOs.: 522 and 521, respectively; (xiv) SEQ ID NOs.: 532 and 531, respectively; (xv) SEQ ID NOs.: 542 and 541, respectively; (xvi) SEQ ID NOs.: 552 and 551, respectively; (xvii) SEQ ID NOs.: 562 and 561, respectively; (xviii) SEQ ID NOs.: 572 and 571, respectively; (xix) SEQ ID NOs.: 582 and 581, respectively; (xx) SEQ ID NOs.: 592 and 591, respectively; (xxi) SEQ ID NOs.:602 and 601, respectively; (xxii) SEQ ID NOs.: 612 and 611, respectively; (xxiii) SEQ ID NOs.: 502 and 501, respectively; or (xxiv) SEQ ID NOs.: 512 and 511, respectively.

In any of the presently disclosed embodiments, a binding protein can further comprise a TCR α chain constant domain (Cα) and/or a TCR β chain constant domain (Cβ). In certain embodiments, the Cα comprises or consists of an amino acid sequence having at least 90% (i.e., 90%, 91%, 92%, 93%, 94%, 95%, 96%, 97%, 98%, 99%, 99.5%, or 100%) identity to the amino acid sequence set forth in SEQ ID NO.:85 or 86. In certain embodiments, the Cβ comprises or consists of an amino acid sequence having at least 90% identity to the amino acid sequence set forth in any one of SEQ ID NOs.: 87-99.

In any of the presently disclosed embodiments, a TCR constant domain can be modified to enhance pairing of desired TCR chains. For example, enhanced pairing in a host T cell between a heterologous TCR α-chain and a heterologous TCR β-chain due to a modification results in the preferential assembly of a TCR comprising two heterologous chains over an undesired mispairing of a heterologous TCR chain with an endogenous TCR chain (see, e.g., Govers et al., *Trends Mol. Med.* 16(2):77 (2010), the TCR modifications of which are herein incorporated by reference). Exemplary modifications to enhance pairing of heterologous TCR chains include the introduction of complementary cysteine residues in each of the heterologous TCR α-chain and β-chain. In some embodiments, a polynucleotide encoding a heterologous TCR α-chain encodes a cysteine at amino acid position 48 (corresponding to the full-length, mature human TCR α-chain sequence) and a polynucleotide encoding a heterologous TCR β-chain encodes a cysteine at amino acid position 57 (corresponding to the full-length mature human TCR β-chain sequence).

In particular embodiments, a binding protein comprises a TCR α chain and a TCR β chain, wherein the TCR α chain and a TCR β chain comprise or consist of an amino acid sequence having at least 90% identity to, comprising, or consisting of the amino acid sequence set forth in: (i) SEQ ID NOs.: 115 and 114, respectively; (ii) SEQ ID NOs.: 101 and 100, respectively; (iii) SEQ ID NOs.: 103 and 102, respectively; (iv) SEQ ID NOs.: 105 and 104, respectively; (v) SEQ ID NOs.: 107 and 106, respectively; (vi) SEQ ID NOs.: 109 and 108, respectively; (vii) SEQ ID NOs.: 111 and 110, respectively; (viii) SEQ ID NOs.: 113 and 112, respectively; (ix) SEQ ID NOs.: 117 and 116, respectively; (x) SEQ ID NOs.: 119 and 118, respectively; (xi) SEQ ID NOs.: 121 and 120, respectively; or (xii) SEQ ID NOs.: 123 and 122, respectively.

In any of the presently disclosed embodiments, the binding protein can comprise a TCR, a single-chain TCR (scTCR), or a chimeric antigen receptor (CAR).

In another aspect, a binding protein is provided that comprises a TCR Vα domain and a TCR Vβ domain and specifically binds to a KRAS peptide:HLA complex, wherein the KRAS peptide comprises or consists of the amino acid sequence set forth in any one of SEQ ID NOs:2-5, and wherein the and the peptide:HLA complex comprises a HLA-A*03:01 molecule. In any of the presently disclosed embodiments, the binding protein can be heterologously expressed by a human immune system cell, such as, for example, a T cell. In certain embodiments, the Vα domain and/or the Vβ domain are each independently human, humanized, or chimeric, and are preferably each human.

In certain embodiments, (i) the Vβ domain comprises the CDR3 amino acid sequence (CDR3β) according from D_3_4.3, D_3_4.6, D_3_4.9, D_3_1.7, D_3_2.10, or D_3_3.6, and the Vα domain comprises the CDR3 amino acid sequence (CDR3α) from D_3_4.3, D_3_4.6, D_3_4.9, D_3_1.7, D_3_2.10, or D_3_3.6; and/or (ii) the binding domain comprises a Vβ domain and/or a Vα domain having at least 90% identity to the Vβ domain or the Vα domain, respectively, of D_3_4.3, D_3_4.6, D_3_4.9, D_3_1.7, D_3_2.10, or D_3_3.6, provided that: (a) at least three or four of the CDRs have no mutations; (b) the CDRs that do have mutations have only up to two amino acid substitutions, up to a contiguous five amino acid deletion, or a combination thereof; and (c) the binding protein retains its ability to bind to a peptide:HLA-A*03:01 complex comprising a KRAS peptide according to any one of SEQ ID NOs:2-5. In certain embodiments, the binding domain comprises a CDR1β, and CDR2β, a CDR1α, and/or a CDR2α of D_3_4.3, D_3_4.6, D_3_4.9, D_3_1.7, D_3_2.10, or D_3_3.6. In further embodiments, the binding domain comprises the Vβ domain and the Vα domain of D_3_4.3, D_3_4.6, D_3_4.9, D_3_1.7, D_3_2.10, or D_3_3.6.

Polynucleotides

In another aspect, the present disclosure provides an isolated polynucleotide encoding any one or more of the presently disclosed binding proteins.

In certain embodiments, the polynucleotide comprises a polynucleotide having at least 75% (i.e., at 75%, 80%, 81%, 82%, 83%, 84%, 85%, 86%, 87%, 88%, 89% 90%, 91%, 92%, 93%, 94%, 95%, 96%, 97%, 98%, 99%, or 100%) identity to the polynucleotide sequence set forth in any one of SEQ ID NOs.: 349, 352, 355, 341, 344, 347, 357, 360, 363, 364, 368, 371, 373, 376, 379, 381, 384, 387, 389, 392, 396, 397, 400, 403, 405, 408, 411, 413, 416, 419, 421, 424, 427, 429, 432, 435, 437, 440, 443, 445, 448, 451, 453, 456, 459, 461, 464, 467, 469, 472, 475, 477, 480, 483, 485, 488, 491, 139, 163, 138, 162, 193, 125, 149, 124, 148, 186, 127, 151, 126, 150, 187, 129, 153, 128, 152, 188, 131, 155, 130, 154, 189, 133, 157, 132, 156, 190, 135, 159, 134, 158, 191, 137, 161, 136, 160, 192, 141, 162, 140, 164, 194, 143, 167, 142, 166, 195, 145, 169, 144, 168, 196, 147, 171, 146, 170, 197, 499, 509, 519, 529, 539, 549, 559, 569, 579, 589, 599, or 609, or any combination thereof. In certain embodiments, the polynucleotide comprises a polynucleotide having at least 75% to the polynucleotide sequence set forth in any one of SEQ ID NOs.:124-171. In certain embodiments, the polynucleotide encoding a binding protein comprises (i) a polynucleotide having at least 75% identity to the polynucleotide sequence set forth in SEQ ID NO:154, and a polynucleotide having at least 75% identity to the polynucleotide sequence set forth in SEQ ID NO:155; (ii) a polynucleotide having at least 75% identity to the polynucleotide sequence set forth in SEQ ID NO:170, and a polynucleotide having at least 75% identity to the polynucleotide sequence set forth in SEQ ID NO:171; (iii) a polynucleotide having at least 75% identity to the polynucleotide sequence set forth in SEQ ID NO:148, and a polynucleotide having at least 75% identity to the polynucleotide sequence set forth in SEQ ID NO:149; (iv) a polynucleotide having at least 75% identity to the polynucleotide sequence set forth in SEQ ID NO:150, and a polynucleotide having at least 75% identity to the polynucleotide sequence set forth in SEQ ID NO:151; (v) a polynucleotide having at least 75% identity to the polynucleotide sequence set forth in SEQ ID NO:152, and a polynucleotide having at least 75% identity to the polynucleotide sequence set forth in SEQ ID NO:153; (vi) a polynucleotide having at least 75% identity to the polynucleotide sequence set forth in SEQ ID NO:156, and a polynucleotide having at least 75% identity to the polynucleotide sequence set forth in SEQ ID NO:157; (vii) a polynucleotide having at least 75% identity to the polynucleotide sequence set forth in SEQ ID NO:158, and a polynucleotide having at least 75% identity to the polynucleotide sequence set forth in SEQ ID NO:159; (viii) a polynucleotide having at least 75% identity to the polynucleotide sequence set forth in SEQ ID NO:160, and a polynucleotide having at least 75% identity to the polynucleotide sequence set forth in SEQ ID NO:161; (ix) a polynucleotide having at least 75% identity to the polynucleotide sequence set forth in SEQ ID NO:162, and a polynucleotide having at least 75% identity to the polynucleotide sequence set forth in SEQ ID NO:163; (x) a polynucleotide having at least 75% identity to the polynucleotide sequence set forth in SEQ ID NO:164, and a polynucleotide having at least 75% identity to the polynucleotide sequence set forth in SEQ ID NO:165; (xi) a polynucleotide having at least 75% identity to the polynucleotide sequence set forth in SEQ ID NO:166, and a polynucleotide having at least 75% identity to the polynucleotide sequence set forth in SEQ ID NO:167; or (xii) a polynucleotide having at least 75% identity to the polynucleotide sequence set forth in SEQ ID NO:168, and a polynucleotide having at least 75% identity to the polynucleotide sequence set forth in SEQ ID NO:169. In some embodiments, a single polynucleotide encodes a binding protein as described herein, or, alternatively, the binding protein may be encoded by more than one polynucleotide. In other words, components or portions of a binding protein may be encoded by two or more polynucleotides, which may be contained on a single nucleic acid molecule or may be contained on two or more nucleic acid molecules.

Also provided is an isolated polynucleotide encoding the amino acid sequence set forth in any one of SEQ ID NOs.: 356, 348, 364, 372, 380, 388, 396, 404, 412, 420, 428, 436, 444, 452, 460, 468, 476, 484, 492, 500, 510, 520, 530, 540, 550, 560, 570, 580, 590, 600, or 610. In certain embodiments, the polynucleotide comprises a polynucleotide having at least 75% (i.e., at 75%, 80%, 81%, 82%, 83%, 84%, 85%, 86%, 87%, 88%, 89% 90%, 91%, 92%, 93%, 94%, 95%, 96%, 97%, 98%, 99%, or 100%) identity to the polynucleotide sequence set forth in any one of SEQ ID NOs.: 355, 347, 363, 371, 379, 387, 395, 403, 411, 419, 427, 435, 443, 451, 459, 467, 475, 483, 491, 186-197, 499, 509, 519, 529, 539, 549, 559, 569, 579, 589, 599, or 609.

During lymphocyte development, Vα exons are assembled from different variable and joining gene segments (V-J), and Vβ exons are assembled from different variable, diversity, and joining gene segments (V-D-J). The TCRα chromosomal locus has 70-80 variable gene segments and 61 joining gene segments. The TCRβ chromosomal locus has 52 variable gene segments, and two separate clusters of each containing a single diversity gene segment, together with six or seven joining gene segments. Functional Vα and Vβ gene exons are generated by the recombination of a variable gene segment with a joining gene segment for Vα, and a variable gene segment with a diversity gene segment and a joining gene segment for Vβ.

In certain embodiments, a polynucleotide encoding a binding protein comprises a TRBV, a TRBD, a TRBJ, a TRAV, and/or a TRAJ gene segment according to any one of the exemplary binding proteins shown in Table 1.

TABLE 1

V-D-J gene usage of exemplary binding proteins

| TCR | TRBV | TRBD | TRBJ | TRAV | TRAJ |
|---|---|---|---|---|---|
| 17 | V28-01*01F | D1*01F | J1-6*01F | V19*01F | J6*01F |
| 14 | V9-01*01F | D2*02F | J2-3*01F | V17*01F | J45*01F |
| 18(1) | V9-01*01F | D1*01F | J2-7*01F | V17 | J45*01F |
| 18(2) | V9-01*01F | D1*01F | J2-7*01F | V17 | J13*01F |
| 13 | V25-01*01F | D1*01F | J2-1*01F | V12-3*01F | J17*01F |
| 22 | V25-01*01F | D2*01F | J2-1*01F | V12-3*01F | J17*01F |
| 19 | V12-04*01F | D1*01F | J2-3*01F | V29/DV5*01F | J43*01F |
| 16 | V12-04*01F | D2*02F | J2-1*01F | V2*01F | J30*01F |
| 20 | V11-02*01F | D2*02F | J2-3*01F | V26-1*01F | J29*01F |
| 21 | V25-01*01F | D1*01F | J2-1*01F | V12-3*01F | J39*01F |
| 24 | V7-09*01F | D2*01F | J2-4*01F | V1-1*01F | J12*01F |
| 23 | V10-01*01F | D1*01F | J2-7*01F | V27*01F | J52*01F |
| 15 | V30*02F | D1*01F | J1-5*01F | V12-2*01F | J39*01F |
| 220_12 | V25-1*01F | D2*01F | J1-1*01F | V8-2*01F or *03F | J41*01F |
| 220_21 | V7-8*01F | D2*01F | J2-2*01F | V5*01F | J29*01F |
| 129-_2 | V5-1*01F | | J2-5*01F | V17*01F | J45*01F |
| 129_4 | V10-1*01F | | J2-2*01F | V13-2*01F | J9*01F |

TABLE 1-continued

V-D-J gene usage of exemplary binding proteins

| TCR | TRBV | TRBD | TRBJ | TRAV | TRAJ |
|---|---|---|---|---|---|
| 129_5 | V28*01F | | J1-3*01F | V17*01F | J53*01F |
| 129_6 | V12-3*01F | | J2-7*01F | V8-3*01F | J40*01F |
| 129_7 | V11-2*01F | | J2-7*01F | V17*01F | J54*01F |
| 129_8 | V7-9*03F | | J2-7*01F | V29/DV5*01F | J27*01F |
| 141_1 | V6-5*01F | | J1-6*01F | V38-2/DV8*01F | J50*01F |
| 141_2 | V4-1*01F | | J1-2*01F | V29/DV5*01F | J34*01F |
| 141_3 | V3-1*01F | | J2-7*01F | V3*01F | J4*01F |
| 141_6 | V11-2*01F | | J2-7*01F | V17*01F | J54*01F |
| 141_7 | V7-9*03F | | J2-2*01F | V8-3*01F | J10*01F |
| A2_KRAS_01 | V15*02F | | J2-5*01F | V17*01 F | J20*01F |
| A2_KRAS_02 | V11-1*01F | | J2-7*01 F | V5*01 F | J34*01F |
| A2_KRAS_03 | V7-3*01 F | | J2-1*01F | V5*01 F | J34*01F |
| A2_KRAS_04 | V20-1*01 F | | J2-3*01 F | V19*01 F | J12*01 F |
| A2_KRAS_05 | V28*01 F | | J2-7*01 F | V8-3*01 F | J8*01 F |
| A2_KRAS_06 | V28*01 F | | J2-7*01 F | V5*01 F | J34*01 F |
| A2_KRAS_07 | V11-1*01 F | | J2-7*01 F | V5*01 F | J34*01 F |
| A2_KRAS_08 | V28*01 F | | J2-7*01 F | V5*01 F | J29*01 F |
| A2_KRAS_09 | V27*01 F | | J2-1*01 F | V13-2*01 F | J20*01 F |
| A2_KRAS_10 | V6-5*01 F | | J1-2*01 F | V8-3*01 F | J33*01 F |
| A2_KRAS_11 | V4-1*01 F | | J2-7*01 F | V29/DV5*01 F | J40*01 F |
| A2_KRAS_12 | V28*01 F | | J1-2*01 F | V8-6*01 F | J30*01 F |
| A2_KRAS_13 | V11-1*01F | | J2-7*01 F | V5*01 F | J34*01 F |
| A2_KRAS_14 | V4-1*01 F | | J2-7*01 F | V29/DV5*01 F | J40*01 F |
| A2_KRAS_19 | V19*01 F | | J2-1*01 F | V8-1*01 F | J20*01 F |
| A2_KRAS_18 | V28*01 F | | J2-3*01 F | V5*01 F | J23*01 F |
| A2_KRAS_17 | V20-1*05 (F) | | J2-5*01 F | V27*01 F | J20*01 F |
| A2_KRAS_16 | V24-1*01 F | | J2-1*01 F | V5*01 F | J23*01 F |
| A2_KRAS_15 | V11-2*03 F | | J2-1*01 F | V5*01 F | J34*01 F |

In certain embodiments, a polynucleotide encoding a Vβ domain comprises (i) a TRBV25-01 gene segment, a TRBV12-04 gene segment, a TRBV28-01 gene segment, a TRBV09-01 gene segment, a TRBV11-02 gene segment, a TRBV07-09 gene segment, a TRBV10-01 gene segment, or a TRBV30-01 gene segment; (ii) a TRBD01-01 gene segment, a TRBD02-01 gene segment, or a TRBD02-02 gene segment; and (iii) a TRBJ02-01 gene segment, a TRBJ01-06 gene segment, a TRBJ02-03 gene segment, a TRBJ02-07 gene segment, a TRBJ02-03 gene segment, a TRBJ02-04 gene segment, or a TRBJ01-05 gene segment.

In certain embodiments, a polynucleotide encoding a Vα domain comprises: (i) a TRAV12-3 gene segment, a TRAV17 gene segment, a TRAV19 gene segment, a TRAV5 gene segment, a TRAV29DV05 gene segment, a TRAV2 gene segment, a TRAV26-1 gene segment, a TRAV1-1 gene segment, a TRAV27 gene segment, or a TRAV12-2 gene segment; and (ii) a TRAJ17 gene segment, a TRAJ45 gene segment, a TRAJ6 gene segment, a TRAJ13 gene segment, a TRAJ43 gene segment, a TRAJ30 gene segment, a TRAJ39 gene segment, a TRAJ12 gene segment, a TRAJ52 gene segment.

In particular embodiments, (i) the polynucleotide encoding the TCR Vβ domain comprises a TRBV25-01 gene segment, a TRBD01-01 gene segment or a TRBD-02-01 gene segment, and a TRBJ02-01 gene segment; and (ii) the polynucleotide encoding the TCR Vα domain comprises a TRAV12-3 gene segment, and a TRAJ17 gene segment or a TRAJ39 gene segment.

In particular embodiments, (i) the polynucleotide encoding the TCR Vβ domain comprises a TRBV09-01 gene segment, a TRBD01-01 gene segment or a TRBD-02-01 gene segment, and a TRBJ02-03 gene segment or a TRBJ02-07 gene segment; and (ii) the polynucleotide encoding the TCR Vα domain comprises a TRAV17 gene segment, and a TRAJ45 gene segment or a TRAJ13 gene segment.

In any of the presently disclosed embodiments, a polynucleotide encoding a binding protein can further comprise: (i) a polynucleotide encoding a polypeptide that comprises an extracellular portion of a CD8 co-receptor α chain, wherein, optionally, the encoded polypeptide is or comprises a CD8 co-receptor α chain; (ii) a polynucleotide encoding a polypeptide that comprises an extracellular portion of a CD8 co-receptor β chain, wherein, optionally, the encoded polypeptide is or comprises a CD8 co-receptor β chain; or (iii) a polynucleotide of (i) and a polynucleotide of (ii). Without being bound by theory, in certain embodiments, co-expression or concurrent expression of a binding protein and a CD8 co-receptor protein or portion thereof functional to bind to an HLA molecule may improve one or more desired activity of a host cell (e.g., immune cell, such as a T cell, optionally a CD4$^+$ T cell) as compared to expression of the binding protein alone. Exemplary amino acid sequences of CD8 co-receptor polypeptides are provided in SEQ ID NOs.:685-690. It will be understood that the binding protein-encoding polynucleotide and the CD8 co-receptor polypeptide-encoding polynucleotide may be present on a single nucleic acid molecule (e.g., in a same expression vector), or may be present on separate nucleic acid molecules in a host cell.

In certain further embodiments, a polynucleotide comprises: (a) the polynucleotide encoding a polypeptide comprising an extracellular portion of a CD8 co-receptor α chain; (b) the polynucleotide encoding a polypeptide comprising an extracellular portion of a CD8 co-receptor β chain; and (c) a polynucleotide encoding a self-cleaving peptide disposed between the polynucleotide of (a) and the polynucleotide of (b). In further embodiments, a polynucleotide comprises a polynucleotide that encodes a self-cleaving peptide and is disposed between: (1) the polynucleotide encoding a binding protein and the polynucleotide encoding a polypeptide comprising an extracellular portion of a CD8 co-receptor α chain; and/or (2) the polynucleotide encoding a binding protein and the polynucleotide encoding a polypeptide comprising an extracellular portion of a CD8 co-receptor β chain.

In still further embodiments, a polynucleotide can comprise, operably linked in-frame: (i) (pnCD8α)-(pnSCP1)-(pnCD8β)-(pnSCP2)-(pnBP); (ii) (pnCD8β)-(pnSCP1)-(pnCD8α)-(pnSCP2)-(pnBP); (iii) (pnBP)-(pnSCP1)-(pnCD8α)-(pnSCP2)-(pnCD8β); (iv) (pnBP)-(pnSCP1)-(pnCD8β)-(pnSCP2)-(pnCD8α); (v) (pnCD8α)-(pnSCP1)-(pnBP)-(pnSCP2)-(pnCD8β); or (vi) (pnCD8β)-(pnSCP1)-(pnBP)-(pnSCP2)-(pnCD8α), wherein pnCD8α is the polynucleotide encoding a polypeptide that comprises an extracellular portion of a CD8 co-receptor α chain, wherein pnCD8β is the polynucleotide encoding a polypeptide that comprises an extracellular portion of a CD8 co-receptor α chain, wherein pnBP is the polynucleotide encoding a binding protein, and wherein pnSCP1 and pnSCP2 are each independently a polynucleotide encoding a self-cleaving peptide, wherein the polynucleotides and/or the encoded self-cleaving peptides are optionally the same or different (e.g., P2A, T2A, F2A, E2A; see, e.g., SEQ ID NOs.:172-185). Exemplary polynucleotide sequences of CD8 co-receptor chains are provided in SEQ ID NOs.:691 and 692. An exemplary polynucleotide sequence encoding a CD8 co-receptor α chain, a self-cleaving peptide, and a CD8 co-receptor β chain is provided in SEQ ID NO.:693. In some embodiments, a polynucleotide of the present disclosure comprises a polynucleotide having at least 75% identity to the polynucleotide sequence set forth in any one of SEQ ID NOs.:691-693.

In certain embodiments, the encoded binding protein comprises a TCRα chain and a TCRβ chain, wherein the polynucleotide comprises a polynucleotide encoding a self-cleaving peptide disposed between the polynucleotide encoding a TCRα chain and the polynucleotide encoding a TCRβ chain. In further embodiments, the polynucleotide comprises, operably linked in-frame: (i) (pnCD8α)-(pnSCP1)-(pnCD8β)-(pnSCP2)-(pnTCRβ)-(pnSCP3)-(pnTCRα); (ii) (pnCD8β)-(pnSCP1)-(pnCD8α)-(pnSCP2)-(pnTCRβ)-(pnSCP3)-(pnTCRα); (iii)(pnCD8α)-(pnSCP1)-(pnCD8β)-(pnSCP2)-(pnTCRα)-(pnSCP3)-(pnTCRβ); (iv) (pnCD8β)-(pnSCP1)-(pnCD8α)-(pnSCP2)-(pnTCRα)-(pnSCP3)-(pnTCRβ); (v) (pnTCRβ)-(pnSCP1)-(pnTCRα)-(pnSCP2)-(pnCD8α)-(pnSCP3)-(pnCD8β); (vi) (pnTCRβ)-(pnSCP1)-(pnTCRα)-(pnSCP2)-(pnCD8β)-(pnSCP3)-(pnCD8α); (vii) (pnTCRα)-(pnSCP1)-(pnTCRβ)-(pnSCP2)-(pnCD8α)-(pnSCP3)-(pnCD8β); (viii) (pnTCRα)-(pnSCP1)-(pnTCRβ)-(pnSCP2)-(pnCD8β)-(pnSCP3)-(pnCD8α), wherein pnCD8α is the polynucleotide encoding a polypeptide that comprises an extracellular portion of a CD8 co-receptor α chain, wherein pnCD8β is the polynucleotide encoding a polypeptide that comprises an extracellular portion of a CD8 co-receptor α chain, wherein pnTCRα is the polynucleotide encoding a TCR α chain, wherein pnTCRβ is the polynucleotide encoding a TCR β chain, and wherein pnSCP1, pnSCP2, and pnSCP3 are each independently a polynucleotide encoding a self-cleaving peptide, wherein the polynucleotides and/or the encoded self-cleaving peptides are optionally the same or different.

In certain embodiments, an encoded polypeptide of the present disclosure comprises one or more junction amino acids. "Junction amino acids" or "junction amino acid residues" refer to one or more (e.g., 2 to about 10) amino acid residues between two adjacent motifs, regions or domains of a polypeptide, such as between a binding domain and an adjacent constant domain or between a TCR chain and an adjacent self-cleaving peptide. Junction amino acids can result from the design of a construct that encodes a fusion protein (e.g., amino acid residues resulting from the use of a restriction enzyme site during the construction of a nucleic acid molecule encoding a fusion protein), or from cleavage of, for example, a self-cleaving peptide adjacent one or more domains of an encoded binding protein of this disclosure (e.g., a P2A peptide disposed between a TCR α-chain and a TCR β-chain, the self-cleavage of which can leave one or more junction amino acids in the α-chain, the TCR β-chain, or both).

In further embodiments, a binding protein is expressed as part of a transgene construct that encodes, and/or a host cell of the present disclosure can encode: one or more additional accessory protein, such as a safety switch protein; a tag, a selection marker; a CD8 co-receptor β-chain; a CD8 co-receptor α-chain or both; or any combination thereof. Polynucleotides and transgene constructs useful for encoding and expressing binding proteins and accessory components (e.g., one or more of a safety switch protein, a selection marker, CD8 co-receptor β-chain, or a CD8 co-receptor α-chain) are described in PCT application PCT/US2017/053112, the polynucleotides, transgene constructs, and accessory components, including the nucleotide and amino acid sequences, of which are hereby incorporated by reference. It will be understood that any or all of a binding protein of the present disclosure, a safety switch protein, a tag, a selection marker, a CD8 co-receptor β-chain, or a CD8 co-receptor α-chain may be encoded by a single nucleic acid molecule or may be encoded by polynucleotide sequences that are, or are present on, separate nucleic acid molecules.

Exemplary safety switch proteins include, for example, a truncated EGF receptor polypeptide (huEGFRt) that is devoid of extracellular N-terminal ligand binding domains and intracellular receptor tyrosine kinase activity, but that retains its native amino acid sequence, has type I transmembrane cell surface localization, and has a conformationally intact binding epitope for pharmaceutical-grade anti-EGFR monoclonal antibody, cetuximab (Erbitux) tEGF receptor (tEGFr; Wang et al., *Blood* 118:1255-1263, 2011); a caspase polypeptide (e.g., iCasp9; Straathof et al., *Blood* 105:4247-4254, 2005; Di Stasi et al., *N. Engl. J. Med.* 365:1673-1683, 2011; Zhou and Brenner, *Exp. Hematol.* pii:S0301-472X(16)30513-6. doi:10.1016/j.exphem.2016.07.011), RQR8 (Philip et al., *Blood* 124:1277-1287, 2014); a 10-amino-acid tag derived from the human c-myc protein (Myc) (Kieback et al., *Proc. Natl. Acad. Sci. USA* 105:623-628, 2008); and a marker/safety switch polypeptide, such as RQR (CD20+CD34; Philip et al., 2014).

Other accessory components useful for modified host cells of the present disclosure comprise a tag or selection marker that allows the cells to be identified, sorted, isolated, enriched, or tracked. For example, marked host cells having desired characteristics (e.g., an antigen-specific TCR and a safety switch protein) can be sorted away from unmarked cells in a sample and more efficiently activated and expanded for inclusion in a product of desired purity.

As used herein, the term "selection marker" comprises a nucleic acid construct (and the encoded gene product) that confers an identifiable change to a cell permitting detection and positive selection of immune cells transduced with a polynucleotide comprising a selection marker. RQR is a selection marker that comprises a major extracellular loop of CD20 and two minimal CD34 binding sites. In some embodiments, an RQR-encoding polynucleotide comprises a polynucleotide that encodes the 16-amino-acid CD34 minimal epitope. In some embodiments, the CD34 minimal epitope is incorporated at the amino terminal position of a CD8 co-receptor stalk domain (Q8). In further embodiments, the CD34 minimal binding site sequence can be combined with a target epitope for CD20 to form a compact marker/suicide gene for T cells (RQR8) (Philip et al., 2014, incorporated by reference herein). This construct allows for the selection of host cells expressing the construct, with for example, CD34 specific antibody bound to magnetic beads (Miltenyi) and that utilizes clinically accepted pharmaceutical antibody, rituximab, that allows for the selective deletion of a transgene expressing engineered T cell (Philip et al., 2014).

Further exemplary selection markers also include several truncated type I transmembrane proteins normally not expressed on T cells: the truncated low-affinity nerve growth factor, truncated CD19, and truncated CD34 (see for example, Di Stasi et al., *N. Engl. J. Med.* 365:1673-1683, 2011; Mavilio et al., *Blood* 83:1988-1997, 1994; Fehse et al., *Mol. Ther.* 1:448-456, 2000; each incorporated herein in their entirety). A useful feature of CD19 and CD34 is the availability of the off-the-shelf Miltenyi CliniMACs™ selection system that can target these markers for clinical-grade sorting. However, CD19 and CD34 are relatively large surface proteins that may tax the vector packaging capacity and transcriptional efficiency of an integrating vector. Surface markers containing the extracellular, non-signaling domains or various proteins (e.g., CD19, CD34, LNGFR) also can be employed. Any selection marker may be employed and should be acceptable for Good Manufacturing Practices. In certain embodiments, selection markers are expressed with a polynucleotide that encodes a gene product of interest (e.g., a binding protein of the present disclosure, such as a TCR or CAR). Further examples of selection markers include, for example, reporters such as GFP, EGFP, β-gal or chloramphenicol acetyltransferase (CAT). In certain embodiments, a selection marker, such as, for example, CD34 is expressed by a cell and the CD34 can be used to select enrich for, or isolate (e.g., by immunomagnetic selection) the transduced cells of interest for use in the methods described herein. As used herein, a CD34 marker is distinguished from an anti-CD34 antibody, or, for example, a scFv, TCR, or other antigen recognition moiety that binds to CD34.

In certain embodiments, a selection marker comprises an RQR polypeptide, a truncated low-affinity nerve growth factor (tNGFR), a truncated CD19 (tCD19), a truncated CD34 (tCD34), or any combination thereof.

Regarding RQR polypeptides, without wishing to be bound by theory, it is believed that distance from the host cell surface is important for RQR polypeptides to function as selection markers/safety switches (Philip et al., 2010 (supra)). In some embodiments, the encoded RQR polypeptide is contained in a β-chain, an α-chain, or both, or a fragment or variant of either or both, of the encoded CD8 co-receptor. In specific embodiments, a modified host cell comprises a heterologous polynucleotide encoding iCasp9 and a heterologous polynucleotide encoding a recombinant CD8 co-receptor protein that comprises a β-chain containing a RQR polypeptide and further comprises a CD8 α-chain.

An encoded CD8 co-receptor includes, in some embodiments, an α-chain or a fragment or variant thereof. An amino acid sequence of the human CD8 co-receptor α-chain precursor is known and is provided at, for example, UniProtKB-P30433 (see also UniProtKB-P31783; -P10732; and -P10731). An encoded CD8 co-receptor includes, in some embodiments, a β-chain or a fragment or variant thereof. An amino acid sequence of the human CD8 co-receptor β-chain precursor is known and is provided at, for example, UniProtKB-P10966 (see also UniProtKB-Q9UQ56; -E9PD41; Q8TD28; and -P30434; and -P05541).

An isolated polynucleotide of this disclosure may further comprise a polynucleotide encoding a safety switch protein, a selection marker, a CD8 co-receptor beta chain, or a CD8 co-receptor alpha chain as disclosed herein, or may comprise a polynucleotide encoding any combination thereof.

In any of the presently disclosed embodiments, a polynucleotide can be codon optimized for expression in a host cell. In some embodiments, the host cell comprises a human immune system cell, such as a T cell, a NK cell, or a NK-T cell (Scholten et al., *Clin. Immunol.* 119:135, 2006). Codon optimization can be performed using known techniques and tools, e.g., using the GenScript® OptimumGene™ tool, or GeneArt (Life Technologies). Codon-optimized sequences include sequences that are partially codon-optimized (i.e., one or more of the codons is optimized for expression in the host cell) and those that are fully codon-optimized. It will be appreciated that in embodiments wherein a polynucleotide encodes more than one polypeptide (e.g., a TCR α chain, a TCR β chain, a CD8 co-receptor α chain, a CD8 co-receptor β chain, and one or more self-cleaving peptides), each polypeptide can independently fully codon optimized, partially codon optimized, or not codon optimized.

Vectors

In another aspect, the present disclosure provides an expression vector, comprising any polynucleotide as provided herein operably linked to an expression control sequence.

Also provided herein are vectors that comprise a polynucleotide or transgene construct of the instant disclosure. Some examples of vectors include plasmids, viral vectors, cosmids, and others. Some vectors may be capable of autonomous replication in a host cell into which they are introduced (e.g., bacterial vectors having a bacterial origin of replication and episomal mammalian vectors), whereas other vectors may be integrated into the genome of a host cell or promote integration of the polynucleotide insert upon introduction into the host cell and thereby replicate along with the host genome (e.g., lentiviral vector, retroviral vector). Additionally, some vectors are capable of directing the expression of genes to which they are operatively linked (these vectors may be referred to as "expression vectors"). According to related embodiments, it is further understood that, if one or more agents (e.g., polynucleotides encoding polypeptides as described herein) are co administered to a subject, that each agent may reside in separate or the same vectors, and multiple vectors (each containing a different agent or the same agent) may be introduced to a cell or cell population or administered to a subject.

In certain embodiments, polynucleotides of the present disclosure may be operatively linked to certain elements of a vector. For example, polynucleotide sequences that are needed to effect the expression and processing of coding sequences to which they are ligated may be operatively linked. Expression control sequences may include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequences); sequences that enhance protein stability; and possibly sequences that enhance protein secretion. Expression control sequences may be operatively linked if they are contiguous with the gene of interest and expression control sequences that act in trans or at a distance to control the gene of interest.

In certain embodiments, the vector comprises a plasmid vector or a viral vector (e.g., a vector selected from lentiviral vector or a γ-retroviral vector). Viral vectors include retrovirus, adenovirus, parvovirus (e.g., adeno-associated viruses), coronavirus, negative strand RNA viruses such as ortho-myxovirus (e.g., influenza virus), rhabdovirus (e.g., rabies and vesicular stomatitis virus), paramyxovirus (e.g., measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Other viruses include Norwalk virus, togavirus, flavivirus, reoviruses, papovavirus, hepadnavirus, and hepatitis virus, for example. Examples of retroviruses include avian leukosis-sarcoma, mammalian C-type, B-type viruses, D type viruses, HTLV-BLV group, lentivirus, and spumavirus (Coffin, J. M., Retroviridae: The viruses and their replication, In Fundamental Virology, Third Edition, B. N. Fields et al., Eds., Lippincott-Raven Publishers, Philadelphia, 1996).

"Retroviruses" are viruses having an RNA genome, which is reverse-transcribed into DNA using a reverse transcriptase enzyme, the reverse-transcribed DNA is then incorporated into the host cell genome. "Gammaretrovirus" refers to a genus of the retroviridae family. Examples of gammaretroviruses include mouse stem cell virus, murine leukemia virus, feline leukemia virus, feline sarcoma virus, and avian reticuloendotheliosis viruses. "Lentiviral vector," as used herein, means HIV-based lentiviral vectors for gene delivery, which can be integrative or non-integrative, have relatively large packaging capacity, and can transduce a range of different cell types. Lentiviral vectors are usually generated following transient transfection of three (packaging, envelope and transfer) or more plasmids into producer cells. Like HIV, lentiviral vectors enter the target cell through the interaction of viral surface glycoproteins with receptors on the cell surface. On entry, the viral RNA undergoes reverse transcription, which is mediated by the viral reverse transcriptase complex. The product of reverse transcription is a double-stranded linear viral DNA, which is the substrate for viral integration into the DNA of infected cells.

In certain embodiments, the viral vector can be a gammaretrovirus, e.g., Moloney murine leukemia virus (MLV)-derived vectors. In other embodiments, the viral vector can be a more complex retrovirus-derived vector, e.g., a lentivirus-derived vector. HIV-1-derived vectors belong to this category. Other examples include lentivirus vectors derived from HIV-2, FIV, equine infectious anemia virus, SIV, and Maedi-Visna virus (ovine lentivirus). Methods of using retroviral and lentiviral viral vectors and packaging cells for transducing mammalian host cells with viral particles containing TCR or CAR transgenes are known in the art and have been previous described, for example, in: U.S. Pat. No. 8,119,772; Walchli et al., *PLoS One* 6:327930, 2011; Zhao et al., *J. Immunol.* 174:4415, 2005; Engels et al., *Hum. Gene Ther.* 14:1155, 2003; Frecha et al., *Mol. Ther.* 18:1748, 2010; and Verhoeyen et al., *Methods Mol. Biol.* 506:97, 2009. Retroviral and lentiviral vector constructs and expression systems are also commercially available. Other viral vectors also can be used for polynucleotide delivery including DNA viral vectors, including, for example adenovirus-based vectors and adeno-associated virus (AAV)-based vectors; vectors derived from herpes simplex viruses (HSVs), including amplicon vectors, replication-defective HSV and attenuated HSV (Krisky et al., Gene Ther. 5:1517, 1998).

Other vectors developed for gene therapy uses can also be used with the compositions and methods of this disclosure. Such vectors include those derived from baculoviruses and α-viruses. (Jolly, D J. 1999. Emerging Viral Vectors. pp 209-40 in Friedmann T. ed. The Development of Human Gene Therapy. New York: Cold Spring Harbor Lab), or plasmid vectors (such as Sleeping Beauty or other transposon vectors).

When a viral vector genome comprises a plurality of polynucleotides to be expressed in a host cell as separate transcripts, the viral vector may also comprise additional sequences between the two (or more) transcripts allowing for bicistronic or multicistronic expression. Examples of such sequences used in viral vectors include internal ribosome entry sites (IRES), furin cleavage sites, viral 2A peptide, or any combination thereof.

In certain embodiments, a vector is capable of delivering the polynucleotide or transgene construct to a host cell (e.g., a hematopoietic progenitor cell or a human immune system cell). In specific embodiments, a vector is capable of delivering a polynucleotide or transgene construct to human immune system cell, such as, for example, a CD4$^+$ T cell, a CD8$^+$ T cell, a CD4$^-$ CD8$^-$ double negative T cell, a stem cell memory T cell, a γδ T cell, a natural killer cell, a dendritic cell, or any combination thereof. In further embodiments, a vector is capable of delivering a transgene construct to a naïve T cell, a central memory T cell, an effector memory T cell, or any combination thereof. In some embodiments, a vector that encodes a polynucleotide or transgene construct of the present disclosure may further comprise a polynucleotide that encodes a nuclease that can be used to perform a chromosomal knockout in a host cell (e.g., a CRISPR-Cas endonuclease or another endonuclease as disclosed herein) or that can be used to deliver a therapeutic polynucleotide or transgene or portion thereof to a host cell in a gene therapy replacement or gene repair therapy. Alternatively, a nuclease used for a chromosomal knockout or a gene replacement or gene repair therapy can be delivered to a host cell independent of a vector that encodes a polynucleotide or transgene construct of this disclosure.

In certain embodiments, the vector is capable of delivering the polynucleotide to a host cell. In further embodiments, the host cell is a hematopoietic progenitor cell or a human immune system cell. In still further embodiments, the human immune system cell is a CD4+ T cell, a CD8+ T cell, a CD4-CD8- double negative T cell, a γδ T cell, a natural killer cell, a natural killer T cell, a macrophage, a monocyte, a dendritic cell, or any combination thereof. In yet further embodiments, the T cell is a naïve T cell, a central memory T cell, an effector memory T cell, or any combination thereof.

In any of the presently disclosed embodiments, the vector is a viral vector. In certain embodiments, the viral vector is a lentiviral vector or a γ-retroviral vector.

Host Cells

Also provided herein are host cells that encode and/or express a binding protein (and, optionally, one or more accessory protein, such as a transduction marker, a CD8 co-receptor polypeptide, or the like, as provided herein). In certain embodiments, a host cell is provided that is modified to comprise a polynucleotide and/or an expression vector of the present disclosure, and/or to express a binding protein of the present disclosure.

Any suitable host cell may be modified to include a heterologous polynucleotide encoding a binding protein of this disclosure, including, for example, an immune cell, such as T cell, a NK cell, or a NK-T cell. In some embodiments, a modified immune cell comprises a CD4+ T cell, a CD8+ T cell, or both. Methods for transfecting/transducing T cells with desired nucleic acids have been described (e.g., U.S. Patent Application Pub. No. US 2004/0087025) as have adoptive transfer procedures using T cells of desired target-specificity (e.g., Schmitt et al., *Hum. Gen.* 20:1240, 2009; Dossett et al., *Mol. Ther.* 17:742, 2009; Till et al., *Blood* 112:2261, 2008; Wang et al., *Hum. Gene Ther.* 18:712, 2007; Kuball et al., *Blood* 109:2331, 2007; US 2011/0243972; US 2011/0189141; Leen et al., *Ann. Rev. Immunol.* 25:243, 2007), such that adaptation of these methodologies to the presently disclosed embodiments is contemplated, based on the teachings herein.

Any appropriate method can be used to transfect or transduce the cells, for example, the T cells, or to administer the polynucleotides or compositions of the present methods. Known methods for delivering polynucleotides to host cells include, for example, use of cationic polymers, lipid-like molecules, and certain commercial products such as, for example, IN-VIVO-JET PEI. Other methods include ex vivo transduction, injection, electroporation, DEAE-dextran, sonication loading, liposome-mediated transfection, receptor-mediated transduction, microprojectile bombardment, transposon-mediated transfer, and the like. Still further methods of transfecting or transducing host cells employ vectors, described in further detail herein.

In certain embodiments, the modified cell comprises a hematopoietic progenitor cell and/or or human immune cell. In some embodiments, the immune cell comprises a T cell, a NK cell, a NK-T cell, a dendritic cell, a macrophage, a monocyte, or any combination thereof. In further embodiments, the immune cell comprises a CD4+ T cell, a CD8+ T cell, a CD4– CD8– double negative T cell, a γδ T cell, or any combination thereof. In certain further embodiments, the immune cell comprises a CD4+ T cell and a CD8+ T cell. In certain still further embodiments, the CD4+ T cell, the CD8+ T cell, or both comprise (i) a polynucleotide encoding a polypeptide that comprises an extracellular portion of a CD8 co-receptor α chain, wherein, optionally, the encoded polypeptide is or comprises a CD8 co-receptor α chain; (ii) a polynucleotide encoding a polypeptide that comprises an extracellular portion of a CD8 co-receptor β chain, wherein, optionally, the encoded polypeptide is or comprises a CD8 co-receptor β chain; or (iii) a polynucleotide of (i) and a polynucleotide of (ii).

In any of the foregoing embodiments, a host cell (e.g., an immune cell) may modified to reduce or eliminate expression of one or more endogenous genes that encode a polypeptide involved in immune signaling or other related activities. Exemplary gene knockouts include those that encode PD-1, LAG-3, CTLA4, TIM3, TIGIT, FasL, an HLA molecule, a TCR molecule, or the like. Without wishing to be bound by theory, certain endogenously expressed immune cell proteins may be recognized as foreign by an allogeneic host receiving the modified immune cells, which may result in elimination of the modified immune cells (e.g., an HLA allele), or may downregulate the immune activity of the modified immune cells (e.g., PD-1, LAG-3, CTLA4, FasL, TIGIT, TIM3), or may interfere with the binding activity of a heterologously expressed binding protein of the present disclosure (e.g., an endogenous TCR of a modified T cell that binds a non-Ras antigen and thereby interferes with the modified immune cell binding a cell that expresses a Ras antigen).

Accordingly, decreasing or eliminating expression or activity of such endogenous genes or proteins can improve the activity, tolerance, or persistence of the modified cells in an autologous or allogeneic host setting, and may allow for universal administration of the cells (e.g., to any recipient regardless of HLA type). In certain embodiments, a modified cell is a donor cell (e.g., allogeneic) or an autologous cell. In certain embodiments, a modified cell of this disclosure comprises a chromosomal gene knockout of one or more of a gene that encodes PD-1, LAG-3, CTLA4, TIM3, TIGIT, FasL, an HLA component (e.g., a gene that encodes an α1 macroglobulin, an α2 macroglobulin, an α3 macroglobulin, a β1 microglobulin, or a β2 microglobulin), or a TCR component (e.g., a gene that encodes a TCR variable region or a TCR constant region) (see, e.g., Torikai et al., *Nature Sci. Rep.* 6:21757 (2016); Torikai et al., *Blood* 119(24):5697 (2012); and Torikai et al., *Blood* 122(8):1341 (2013), the gene-editing techniques, compositions, and adoptive cell therapies of which are herein incorporated by reference in their entirety).

As used herein, the term "chromosomal gene knockout" refers to a genetic alteration or introduced inhibitory agent in a host cell that prevents (e.g., reduces, delays, suppresses, or abrogates) production, by the host cell, of a functionally active endogenous polypeptide product. Alterations resulting in a chromosomal gene knockout can include, for example, introduced nonsense mutations (including the formation of premature stop codons), missense mutations, gene deletion, and strand breaks, as well as the heterologous expression of inhibitory nucleic acid molecules that inhibit endogenous gene expression in the host cell.

In certain embodiments, a chromosomal gene knock-out or gene knock-in is made by chromosomal editing of a host cell. Chromosomal editing can be performed using, for example, endonucleases. As used herein "endonuclease" refers to an enzyme capable of catalyzing cleavage of a phosphodiester bond within a polynucleotide chain. In certain embodiments, an endonuclease is capable of cleaving a targeted gene thereby inactivating or "knocking out" the targeted gene. An endonuclease may be a naturally occurring, recombinant, genetically modified, or fusion endonuclease. The nucleic acid strand breaks caused by the endonuclease are commonly repaired through the distinct mechanisms of homologous recombination or non-homologous end joining (NHEJ). During homologous recombination, a donor nucleic acid molecule may be used for a donor gene "knock-in", for target gene "knock-out", and optionally to inactivate a target gene through a donor gene knock in or target gene knock out event. NHEJ is an error-prone repair process that often results in changes to the DNA sequence at the site of the cleavage, e.g., a substitution, deletion, or addition of at least one nucleotide. NHEJ may be used to "knock-out" a target gene. Examples of endonucleases include zinc finger nucleases, TALE-nucleases, CRISPR-Cas nucleases, meganucleases, and megaTALs.

As used herein, a "zinc finger nuclease" (ZFN) refers to a fusion protein comprising a zinc finger DNA-binding domain fused to a non-specific DNA cleavage domain, such as a FokI endonuclease. Each zinc finger motif of about 30 amino acids binds to about 3 base pairs of DNA, and amino acids at certain residues can be changed to alter triplet sequence specificity (see, e.g., Desjarlais et al., *Proc. Natl. Acad. Sci.* 90:2256-2260, 1993; Wolfe et al., *J. Mol. Biol.* 285:1917-1934, 1999). Multiple zinc finger motifs can be linked in tandem to create binding specificity to desired DNA sequences, such as regions having a length ranging from about 9 to about 18 base pairs. By way of background, ZFNs mediate genome editing by catalyzing the formation of a site-specific DNA double strand break (DSB) in the genome, and targeted integration of a transgene comprising flanking sequences homologous to the genome at the site of DSB is facilitated by homology directed repair. Alternatively, a DSB generated by a ZFN can result in knock out of target gene via repair by non-homologous end joining (NHEJ), which is an error-prone cellular repair pathway that results in the insertion or deletion of nucleotides at the cleavage site. In certain embodiments, a gene knockout comprises an insertion, a deletion, a mutation or a combination thereof, made using a ZFN molecule.

As used herein, a "transcription activator-like effector nuclease" (TALEN) refers to a fusion protein comprising a TALE DNA-binding domain and a DNA cleavage domain, such as a Fokl endonuclease. A "TALE DNA binding domain" or "TALE" is composed of one or more TALE repeat domains/units, each generally having a highly conserved 33-35 amino acid sequence with divergent 12th and 13th amino acids. The TALE repeat domains are involved in binding of the TALE to a target DNA sequence. The divergent amino acid residues, referred to as the Repeat Variable Diresidue (RVD), correlate with specific nucleotide recognition. The natural (canonical) code for DNA recognition of these TALEs has been determined such that an HD (histine-aspartic acid) sequence at positions 12 and 13 of the TALE leads to the TALE binding to cytosine (C), NG (asparagine-glycine) binds to a T nucleotide, NI (asparagine-isoleucine) to A, NN (asparagine-asparagine) binds to a G or A nucleotide, and NG (asparagine-glycine) binds to a T nucleotide. Non-canonical (atypical) RVDs are also known (see, e.g., U.S. Patent Publication No. US 2011/0301073, which atypical RVDs are incorporated by reference herein in their entirety). TALENs can be used to direct site-specific double-strand breaks (DSB) in the genome of T cells. Non-homologous end joining (NHEJ) ligates DNA from both sides of a double-strand break in which there is little or no sequence overlap for annealing, thereby introducing errors that knock out gene expression. Alternatively, homology directed repair can introduce a transgene at the site of DSB providing homologous flanking sequences are present in the transgene. In certain embodiments, a gene knockout comprises an insertion, a deletion, a mutation or a combination thereof, and made using a TALEN molecule.

As used herein, a "clustered regularly interspaced short palindromic repeats/Cas" (CRISPR/Cas) nuclease system refers to a system that employs a CRISPR RNA (crRNA)-guided Cas nuclease to recognize target sites within a genome (known as protospacers) via base-pairing complementarity and then to cleave the DNA if a short, conserved protospacer associated motif (PAM) immediately follows 3' of the complementary target sequence. CRISPR/Cas systems are classified into three types (i.e., type I, type II, and type III) based on the sequence and structure of the Cas nucleases. The crRNA-guided surveillance complexes in types I and III need multiple Cas subunits. Type II system, the most studied, comprises at least three components: an RNA-guided Cas9 nuclease, a crRNA, and a trans-acting crRNA (tracrRNA). The tracrRNA comprises a duplex forming region. A crRNA and a tracrRNA form a duplex that is capable of interacting with a Cas9 nuclease and guiding the Cas9/crRNA:tracrRNA complex to a specific site on the target DNA via Watson-Crick base-pairing between the spacer on the crRNA and the protospacer on the target DNA upstream from a PAM. Cas9 nuclease cleaves a double-stranded break within a region defined by the crRNA spacer. Repair by NHEJ results in insertions and/or deletions which disrupt expression of the targeted locus. Alternatively, a transgene with homologous flanking sequences can be introduced at the site of DSB via homology directed repair. The crRNA and tracrRNA can be engineered into a single guide RNA (sgRNA or gRNA) (see, e.g., Jinek et al., *Science* 337:816-21, 2012). Further, the region of the guide RNA complementary to the target site can be altered or programed to target a desired sequence (Xie et al., *PLOS One* 9:e100448, 2014; U.S. Pat. Appl. Pub. No. US 2014/0068797, U.S. Pat. Appl. Pub. No. US 2014/0186843; U.S. Pat. No. 8,697,359, and PCT Publication No. WO 2015/071474; each of which is incorporated by reference). In certain embodiments, a gene knockout comprises an insertion, a deletion, a mutation or a combination thereof, and made using a CRISPR/Cas nuclease system.

Exemplary gRNA sequences and methods of using the same to knock out endogenous genes that encode immune cell proteins include those described in Ren et al., *Clin. Cancer Res.* 23(9):2255-2266 (2017), the gRNAs, CAS9 DNAs, vectors, and gene knockout techniques of which are hereby incorporated by reference in their entirety.

As used herein, a "meganuclease," also referred to as a "homing endonuclease," refers to an endodeoxyribonuclease characterized by a large recognition site (double stranded DNA sequences of about 12 to about 40 base pairs). Meganucleases can be divided into five families based on sequence and structure motifs: LAGLIDADG, GIY-YIG, HNH, His-Cys box and PD-(D/E)XK. Exemplary meganucleases include I-SceI, I-CeuI, PI-PspI, PI-Sce, I-SceIV, I-CsmI, I-PanI, I-SceII, I-PpoI, I-SceIII, I-CreI, I-TevI, I-TevII and I-TevIII, whose recognition sequences are known (see, e.g., U.S. Pat. Nos. 5,420,032 and 6,833,252; Belfort et al., *Nucleic Acids Res.* 25:3379-3388, 1997; Dujon et al., *Gene* 82:115-118, 1989; Perler et al., *Nucleic Acids Res.* 22:1125-1127, 1994; Jasin, *Trends Genet.* 12:224-228, 1996; Gimble et al., *J. Mol. Biol.* 263:163-180, 1996; Argast et al., *J. Mol. Biol.* 280:345-353, 1998).

In certain embodiments, naturally occurring meganucleases may be used to promote site-specific genome modification of a target selected from PD-1, LAG3, TIM3, CTLA4, TIGIT, FasL, an HLA-encoding gene, or a TCR component-encoding gene. In other embodiments, an engineered meganuclease having a novel binding specificity for a target gene is used for site-specific genome modification (see, e.g., Porteus et al., *Nat. Biotechnol.* 23:967-73, 2005; Sussman et al., *J. Mol. Biol.* 342:31-41, 2004; Epinat et al., *Nucleic Acids Res.* 31:2952-62, 2003; Chevalier et al., *Molec. Cell* 10:895-905, 2002; Ashworth et al., *Nature* 441:656-659, 2006; Paques et al., *Curr. Gene Ther.* 7:49-66, 2007; U.S. Patent Publication Nos. US 2007/0117128; US 2006/0206949; US 2006/0153826; US 2006/0078552; and US 2004/0002092). In further embodiments, a chromosomal gene knockout is generated using a homing endonuclease that has been modified with modular DNA binding domains of TALENs to make a fusion protein known as a megaTAL. MegaTALs can be utilized to not only knock-out one or more target genes, but to also introduce (knock in) heterologous or exogenous polynucleotides when used in combination with an exogenous donor template encoding a polypeptide of interest.

In certain embodiments, a chromosomal gene knockout comprises an inhibitory nucleic acid molecule that is introduced into a host cell (e.g., an immune cell) comprising a heterologous polynucleotide encoding an antigen-specific receptor that specifically binds to a tumor associated antigen, wherein the inhibitory nucleic acid molecule encodes a target-specific inhibitor and wherein the encoded target-specific inhibitor inhibits endogenous gene expression (e.g., of PD-1, TIM3, LAG3, CTLA4, TIGIT, FasL, an HLA component, or a TCR component, or any combination thereof) in the host cell.

A chromosomal gene knockout can be confirmed directly by DNA sequencing of the host immune cell following use of the knockout procedure or agent. Chromosomal gene knockouts can also be inferred from the absence of gene expression (e.g., the absence of an mRNA or polypeptide product encoded by the gene) following the knockout.

In certain embodiments, a chromosomal gene knockout comprises a knockout of an HLA component gene selected from an α1 macroglobulin gene, an α2 macroglobulin gene, an α3 macroglobulin gene, a β1 microglobulin gene, or a β2 microglobulin gene.

In certain embodiments, a chromosomal gene knockout comprises a knockout of a TCR component gene selected from a TCR α variable region gene, a TCR β variable region gene, a TCR constant region gene, or a combination thereof.

Host Cell Compositions and Unit Doses

In another aspect, compositions and unit doses are provided herein that comprise a modified host cell of the present disclosure and a pharmaceutically acceptable carrier, diluent, or excipient.

In certain embodiments, a host cell composition or unit dose comprises (i) a composition comprising at least about 30%, at least about 40%, at least about 50%, at least about 60%, at least about 70%, at least about 80%, at least about 85%, at least about 90%, or at least about 95% modified CD4$^+$ T cells, combined with (ii) a composition comprising at least about 30%, at least about 40%, at least about 50%, at least about 60%, at least about 70%, at least about 80%, at least about 85%, at least about 90%, or at least about 95% modified CD8$^+$ T cells, in about a 1:1 ratio, wherein the unit dose contains a reduced amount or substantially no naïve T cells (i.e., has less than about 50%, less than about 40%, less than about 30%, less then about 20%, less than about 10%, less than about 5%, or less then about 1% the population of naïve T cells present in a unit dose as compared to a patient sample having a comparable number of PBMCs).

In some embodiments, a host cell composition or unit dose comprises (i) a composition comprising at least about 50% modified CD4$^+$ T cells, combined with (ii) a composition comprising at least about 50% modified CD8$^+$ T cells, in about a 1:1 ratio, wherein the host cell composition or unit dose contains a reduced amount or substantially no naïve T cells. In further embodiments, a host cell composition or unit dose comprises (i) a composition comprising at least about 60% modified CD4$^+$ T cells, combined with (ii) a composition comprising at least about 60% modified CD8$^+$ T cells, in about a 1:1 ratio, wherein the unit dose contains a reduced amount or substantially no naïve T cells. In still further embodiments, a host cell composition or unit dose comprises (i) a composition comprising at least about 70% engineered CD4$^+$ T cells, combined with (ii) a composition comprising at least about 70% engineered CD8$^+$ T cells, in about a 1:1 ratio, wherein the unit dose contains a reduced amount or substantially no naïve T cells. In some embodiments, a host cell composition or unit dose comprises (i) a composition comprising at least about 80% modified CD4$^+$ T cells, combined with (ii) a composition comprising at least about 80% modified CD8$^+$ T cells, in about a 1:1 ratio, wherein the host cell composition or unit dose contains a reduced amount or substantially no naïve T cells. In some embodiments, a host cell composition or unit dose comprises (i) a composition comprising at least about 85% modified CD4$^+$ T cells, combined with (ii) a composition comprising at least about 85% modified CD8$^+$ T cells, in about a 1:1 ratio, wherein the host cell composition or unit dose contains a reduced amount or substantially no naïve T cells. In some embodiments, a host cell composition or unit dose comprises (i) a composition comprising at least about 90% modified CD4$^+$ T cells, combined with (ii) a composition comprising at least about 90% modified CD8$^+$ T cells, in about a 1:1 ratio, wherein the host cell composition or unit dose contains a reduced amount or substantially no naïve T cells.

It will be appreciated that a host cell composition or unit dose of the present disclosure may comprise any host cell as described herein, or any combination of host cells. In certain embodiments, for example, a host cell composition or unit dose comprises modified CD8+ T cells, modified CD4+ T cells, or both, wherein these T cells are modified to encode a binding protein specific for a Ras peptide:HLA-A*02:01 complex, and further comprises modified CD8+ T cells, modified CD4+ T cells, or both, wherein these T cells are modified to encode a binding protein specific for a Ras peptide:HLA-A*11:01 complex. In addition or alternatively, a host cell composition or unit dose of the present disclosure can comprise any host cell or combination of host cells as described herein, and can further comprise a modified cell (e.g., immune cell, such as a T cell) expressing a binding protein specific for a different antigen (e.g., a different Ras antigen, or an antigen from a different protein or target, such as, for example, BCMA, CD3, CEACAM6, c-Met, EGFR, EGFRvIII, ErbB2, ErbB3, ErbB4, EphA2, IGF1R, GD2, O-acetyl GD2, O-acetyl GD3, GHRHR, GHR, FLT1, KDR, FLT4, CD44v6, CD151, CA125, CEA, CTLA-4, GITR, BTLA, TGFBR2, TGFBR1, IL6R, gp130, Lewis A, Lewis Y, TNFR1, TNFR2, PD1, PD-L1, PD-L2, HVEM, MAGE-A (e.g., including MAGE-A1, MAGE-A3, and MAGE-A4), mesothelin, NY-ESO-1, PSMA, RANK, ROR1, TNFRSF4, CD40, CD137, TWEAK-R, HLA, tumor- or pathogen-associated peptide bound to HLA, hTERT peptide bound to HLA, tyrosinase peptide bound to HLA, WT-1 peptide bound to HLA, LTβR, LIFRβ, LRP5, MUC1, OSMRβ, TCRα, TCRβ, CD19, CD20, CD22, CD25, CD28, CD30, CD33, CD52, CD56, CD79a, CD79b, CD80, CD81, CD86, CD123, CD171, CD276, B7H4, TLR7, TLR9, PTCH1, WT-1, HA$^1$-H, Robo1, α-fetoprotein (AFP), Frizzled, OX40, PRAME, and SSX-2. or the like). For example, a unit dose can comprise modified CD8$^+$ T cells expressing a binding protein that specifically binds to a Ras-HLA complex and modified CD4$^+$ T cells (and/or modified CD8$^+$ T cells) expressing a binding protein (e.g., a CAR) that specifically binds to a PSMA antigen. It will also be appreciated that any of the host cells disclosed herein may be administered in a combination therapy.

In any of the embodiments described herein, a host cell composition or unit dose comprises equal, or approximately equal numbers of engineered CD45RA$^-$ CD3$^+$ CD8$^+$ and modified CD45RA$^-$ CD3$^+$ CD4$^+$ T$_M$ cells.

Immunogenic Peptides

In another aspect, the present disclosure provides an immunogenic polypeptide comprising or consisting of the amino acid sequence set forth in any one or more of SEQ ID NOs:198-201. In certain embodiments, the polypeptide comprises two or more of SEQ ID NOs.:198-201. In certain embodiments, the immunogenic polypeptide is comprised in a composition that further comprises a pharmaceutically acceptable carrier, excipient, or diluent. In further embodiments, the composition comprises one or more additional immunogenic polypeptide, and/or an adjuvant.

Uses

In additional aspects, the present disclosure provides methods for treating or for preventing a relapse of a disease or disorder associated with a KRAS G12D mutation or a KRAS G12V or a NRAS G12D mutation or a NRAS G12V mutation or a HRAS G12V mutation or a HRAS G12D mutation in a subject. Such diseases or disorders include, for example, cancers, such as solid cancers and hematological malignancies. In certain exemplary embodiments, the disease or disorder comprises a pancreas cancer or carcinoma, optionally a pancreatic ductal adenocarcinoma (PDAC); a colorectal cancer or carcinoma; a lung cancer, optionally a non-small-cell lung carcinoma; a biliary cancer; an endometrial cancer or carcinoma; a cervical cancer; an ovarian cancer; a bladder cancer; a liver cancer; a myeloid leukemia, optionally myeloid leukemia such as acute myeloid leukemia; a myelodysplastic syndrome; a lymphoma such as Non-Hodgkin lymphoma; Chronic Melyomonocytic Leukemia; Acute Lymphoblastic Leukemia (ALL); a cancer of the urinary tract; a cancer of the small intestine; a breast cancer or carcinoma; a melanoma (optionally a cutaneous melanoma, an anal melanoma, or a mucosal melanoma); a glioma; a poorly differentiated thyroid gland carcinoma; a neuroblastoma; a histiocytic and dendritic cell neoplasm; neurofibromatisis Type 1; rhabdomyosarcoma; a soft tissue sarcoma; a bladder carcinoma; a sarcoma; a glioblastoma; a squamous cell lung carcinoma; an anaplastic astrocytoma; chronic myeloid leukemia; diffuse large B-cell lymphoma; double-hit lymphpoma; head and neck carcinoma; head and neck squamous cell carcinoma; hepatocellular carcinoma; malignant peripheral nerve sheath tumor; mantle cell lymphoma; myelodyspastic/myeloproliferative neoplasm, unclassifiable; peripheral T cell lymphoma; prostate carcinoma; refractory anemia with excess blasts-2; renal cell carcinoma; rhabdoid tumor; schwannoma; secondary AML; small cell lung carcinoma; therapy-related AML; thymic carcinoma; thyroid gland follyicular carcinoma; malignant thyroid gland neoplasm; thyroid gland carcinoma; thyroid gland adenocarcinoma; urothelial carcinoma; or thyroid gland papillary carcinoma.

"Treat" or "treatment" or "ameliorate" refers to medical management of a disease, disorder, or condition of a subject (e.g., a human or non-human mammal, such as a primate, horse, cat, dog, goat, mouse, or rat). In general, an appropriate dose or treatment regimen comprising a composition (e.g., comprising a binding protein, polynucleotide, vector, host cell, host cell composition, unit dose, and/or immunogenic polypeptide) of the present disclosure is administered in an amount sufficient to elicit a therapeutic or prophylactic benefit. Therapeutic or prophylactic/preventive benefit includes improved clinical outcome; lessening or alleviation of symptoms associated with a disease; decreased occurrence of symptoms; improved quality of life; longer disease-free status; diminishment of extent of disease, stabilization of disease state; delay of disease progression; remission; survival; prolonged survival; or any combination thereof.

A "therapeutically effective amount" or "effective amount", as used herein, refers to an amount of a composition sufficient to result in a therapeutic effect, including improved clinical outcome; lessening or alleviation of symptoms associated with a disease; decreased occurrence of symptoms; improved quality of life; longer disease-free status; diminishment of extent of disease, stabilization of disease state; delay of disease progression; remission; survival; or prolonged survival in a statistically significant manner. When referring to an individual active ingredient or a cell expressing a single active ingredient, administered alone, a therapeutically effective amount refers to the effects of that ingredient or cell expressing that ingredient alone. When referring to a combination, a therapeutically effective amount refers to the combined amounts of active ingredients or combined adjunctive active ingredient with a cell expressing an active ingredient that results in a therapeutic effect, whether administered serially or simultaneously. A combination may also be a cell expressing more than one active ingredient.

The term "pharmaceutically acceptable excipient or carrier" or "physiologically acceptable excipient or carrier" refer to biologically compatible vehicles, e.g., physiological saline, which are described in greater detail herein, that are suitable for administration to a human or other non-human mammalian subject and generally recognized as safe or not causing a serious adverse event.

As used herein, "statistically significant" refers to a p value of 0.050 or less when calculated using the Students t-test and indicates that it is unlikely that a particular event or result being measured has arisen by chance.

Subjects that can be treated by the present invention are, in general, human and other primate subjects, such as monkeys and apes for veterinary medicine purposes. In any of the aforementioned embodiments, the subject may be a human subject. The subjects can be male or female and can be any suitable age, including infant, juvenile, adolescent, adult, and geriatric subjects. Compositions according to the present disclosure may be administered in a manner appropriate to the disease, condition, or disorder to be treated as determined by persons skilled in the medical art. In any of the above embodiments, a modified host cell, host cell composition, or unit dose as described herein is administered intravenously, intraperitoneally, intratumorally, into the bone marrow, into a lymph node, or into the cerebrospinal fluid so as to encounter target cells (e.g., leukemia cells). An appropriate dose, suitable duration, and frequency of administration of the compositions will be determined by such factors as a condition of the patient; size, type, and severity of the disease, condition, or disorder; the particular form of the active ingredient; and the method of administration.

As used herein, the term "adoptive immune therapy" or "adoptive immunotherapy" refers to administration of naturally occurring or genetically engineered, disease- or antigen-specific immune cells (e.g., T cells). Adoptive cellular immunotherapy may be autologous (immune cells are from the recipient), allogeneic (immune cells are from a donor of the same species) or syngeneic (immune cells are from a donor genetically identical to the recipient).

In some embodiments, the subject expresses a Ras antigen comprising or consisting of the amino acid sequence set forth in any one of SEQ ID NOs:2-5 and 198-101.

In some embodiments, the subject is HLA-A*11:01+; HLA-A*03:01+; or HLA-A*02:01+.

In certain embodiments, a method comprises determining the HLA type or types of a subject and/or identifying the presence of a Ras antigen, prior to administering therapy according to the present disclosure.

In particular embodiments, a method comprises administering (i) a composition comprising modified CD8+ and/or modified CD4+ T cells that comprise a heterologous polynucleotide encoding a first binding protein as provided herein, when the subject expresses HLA-A*02:01; and/or (ii) a composition comprising modified CD8+ and/or modified CD4+ T cells that comprise a heterologous polynucleotide encoding a second binding protein as provided herein, when the subject expresses HLA-A*11:01. In further embodiments, if both the composition of (i) and the composition of (ii) are administered, the composition of (i) and the composition of (ii) are comprised in the same composition or are administered as separate compositions.

In the case of host cell compositions or unit doses, the amount of cells therein is at least one cell (for example, one modified CD8$^+$ T cell subpopulation (e.g., optionally comprising memory and/or naïve CD8$^+$ T cells); one modified CD4$^+$ T cell subpopulation (e.g., optionally comprising memory and/or naïve CD4$^+$ T cells)) or is more typically greater than $10^2$ cells, for example, up to $10^4$, up to $10^5$, up to $10^6$, up to $10^7$, up to $10^8$, up to $10^9$, or more than $10^{10}$ cells. In certain embodiments, the cells are administered in a range from about $10^4$ to about $10^{10}$ cells/m$^2$, preferably in a range of about $10^5$ to about $10^9$ cells/m$^2$. In some embodiments, an administered dose comprises up to about $3.3\times10^5$ cells/kg. In some embodiments, an administered dose comprises up to about $1\times10^6$ cells/kg. In some embodiments, an administered dose comprises up to about $3.3\times10^6$ cells/kg. In some embodiments, an administered dose comprises up to about $1\times10^7$ cells/kg. In certain embodiments, a modified immune cell is administered to a subject at a dose comprising up to about $5\times10^4$ cells/kg, $5\times10^5$ cells/kg, $5\times10^6$ cells/kg, or up to about $5\times10^7$ cells/kg. In certain embodiments, a modified immune cell is administered to a subject at a dose comprising at least about $5\times10^4$ cells/kg, $5\times10^5$ cells/kg, $5\times10^6$ cells/kg, or up to about $5\times10^7$ cells/kg. The number of cells will depend upon the ultimate use for which the composition is intended as well the type of cells included therein. For example, cells modified to contain a binding protein will comprise a cell population containing at least 30%, 35%, 40%, 45%, 50%, 55%, 60%, 65%, 70%, 75%, 80%, 85%, 90%, 95% or more of such cells. For uses provided herein, cells are generally in a volume of a liter or less, 500 mls or less, 250 mls or less, or 100 mls or less. In embodiments, the density of the desired cells is typically greater than $10^4$ cells/ml and generally is greater than $10^7$ cells/ml, generally $10^8$ cells/ml or greater. The cells may be administered as a single infusion or in multiple infusions over a range of time. A clinically relevant number of immune cells can be apportioned into multiple infusions that cumulatively equal or exceed $10^6$, $10^7$, $10^8$, $10^9$, $10^{10}$, or $10^{11}$ cells. In certain embodiments, a unit dose of the modified immune cells can be co-administered with (e.g., simultaneously or contemporaneously with) hematopoietic stem cells from an allogeneic donor. In some embodiments, one or more of the modified immune cells comprised in the unit dose is autologous to the subject.

In some embodiments, the subject receiving the modified immune cell has previously received lymphodepleting chemotherapy. In further embodiments, the lymphodepleting chemotherapy comprises cyclophosphamide, fludarabine, anti-thymocyte globulin, or a combination thereof.

In some embodiments, the method further comprises administering an inhibitor of an immune checkpoint molecule, as disclosed herein, to the subject.

Also contemplated are pharmaceutical compositions (i.e., compositions) that comprise a composition (binding protein, polynucleotide, vector, host cell, host cell composition, unit dose, and/or immunogenic polypeptide) as disclosed herein and a pharmaceutically acceptable carrier, diluents, or excipient. Suitable excipients include water, saline, dextrose, glycerol, or the like and combinations thereof. In embodiments, compositions comprising fusion proteins or host cells as disclosed herein further comprise a suitable infusion media. Suitable infusion media can be any isotonic medium formulation, typically normal saline, Normosol R (Abbott) or Plasma-Lyte A (Baxter), 5% dextrose in water, Ringer's lactate can be utilized. An infusion medium can be supplemented with human serum albumin or other human serum components.

Pharmaceutical compositions may be administered in a manner appropriate to the disease or condition to be treated (or prevented) as determined by persons skilled in the medical art. An appropriate dose and a suitable duration and frequency of administration of the compositions will be determined by such factors as the health condition of the patient, size of the patient (i.e., weight, mass, or body area), the type and severity of the patient's condition, the particular form of the active ingredient, and the method of administration. In general, an appropriate dose and treatment regimen provide the composition(s) in an amount sufficient to provide therapeutic and/or prophylactic benefit (such as described herein, including an improved clinical outcome, such as more frequent complete or partial remissions, or longer disease-free and/or overall survival, or a lessening of symptom severity).

An effective amount of a pharmaceutical composition refers to an amount sufficient, at dosages and for periods of time needed, to achieve the desired clinical results or beneficial treatment, as described herein. An effective amount may be delivered in one or more administrations. If the administration is to a subject already known or confirmed to have a disease or disease-state, the term "therapeutic amount" may be used in reference to treatment, whereas "prophylactically effective amount" may be used to describe administrating an effective amount to a subject that is susceptible or at risk of developing a disease or disease-state (e.g., recurrence) as a preventative course.

The pharmaceutical compositions described herein may be presented in unit-dose or multi-dose containers, such as sealed ampoules or vials. Such containers may be frozen to preserve the stability of the formulation until infusion into the patient. Doses will vary, but a preferred dose for administration of a modified immune cell as described herein is about $10^4$ cells/m$^2$, about $5\times10^4$ cells/m$^2$, about $10^5$ cells/m$^2$, about $5\times10^5$ cells/m$^2$, about $10^6$ cells/m$^2$, about $5\times10^6$ cells/m$^2$, about $10^7$ cells/m$^2$, about $5\times10^7$ cells/m$^2$, about $10^8$ cells/m$^2$, about $5\times10^8$ cells/m$^2$, about $10^9$ cells/m$^2$, about $5\times10^9$ cells/m$^2$, about $10^{10}$ cells/m$^2$, about $5\times10^{10}$ cells/m$^2$, or about $10^{11}$ cells/m$^2$. In certain embodiments, a unit dose comprises a modified immune cell as described herein at a dose of about $10^4$ cells/m$^2$ to about $10^{11}$ cells/m$^2$. The development of suitable dosing and treatment regimens for using the particular compositions described herein in a variety of treatment regimens, including e.g., parenteral or intravenous administration or formulation.

If the subject composition is administered parenterally, the composition may also include sterile aqueous or oleaginous solution or suspension. Suitable non-toxic parenterally acceptable diluents or solvents include water, Ringer's solution, isotonic salt solution, 1,3-butanediol, ethanol, propylene glycol or polythethylene glycols in mixtures with water. Aqueous solutions or suspensions may further comprise one or more buffering agents, such as sodium acetate, sodium citrate, sodium borate or sodium tartrate. Of course, any material used in preparing any dosage unit formulation should be pharmaceutically pure and substantially non-toxic in the amounts employed. In addition, the active compounds may be incorporated into sustained-release preparation and formulations. Dosage unit form, as used herein, refers to physically discrete units suited as unitary dosages for the subject to be treated; each unit may contain a predetermined quantity of engineered immune cells or active compound calculated to produce the desired effect in association with an appropriate pharmaceutical carrier.

In general, an appropriate dosage and treatment regimen provides the active molecules or cells in an amount sufficient to provide a benefit. Such a response can be monitored by establishing an improved clinical outcome (e.g., more frequent remissions, complete or partial, or longer disease-free survival) in treated subjects as compared to non-treated subjects. Increases in preexisting immune responses to a tumor protein generally correlate with an improved clinical outcome. Such immune responses may generally be evaluated using standard proliferation, cytotoxicity or cytokine assays, which are routine.

For prophylactic use, a dose should be sufficient to prevent, delay the onset of, or diminish the severity of a disease associated with disease or disorder. Prophylactic benefit of the immunogenic compositions administered according to the methods described herein can be determined by performing pre-clinical (including in vitro and in vivo animal studies) and clinical studies and analyzing data obtained therefrom by appropriate statistical, biological, and clinical methods and techniques, all of which can readily be practiced by a person skilled in the art.

As used herein, administration of a composition refers to delivering the same to a subject, regardless of the route or mode of delivery. Administration may be effected continuously or intermittently, and parenterally. Administration may be for treating a subject already confirmed as having a recognized condition, disease or disease state, or for treating a subject susceptible to or at risk of developing such a condition, disease or disease state. Co-administration with an adjunctive therapy may include simultaneous and/or sequential delivery of multiple agents in any order and on any dosing schedule (e.g., modified immune cells with one or more cytokines; immunosuppressive therapy such as calcineurin inhibitors, corticosteroids, microtubule inhibitors, low dose of a mycophenolic acid prodrug, or any combination thereof).

In certain embodiments, a plurality of doses of a composition described herein is administered to the subject, which may be administered at intervals between administrations of about two to about four weeks.

Treatment or prevention methods of this disclosure may be administered to a subject as part of a treatment course or regimen, which may comprise additional treatments prior to, or after, administration of the instantly disclosed unit doses, cells, or compositions. For example, in certain embodiments, a subject receiving a unit dose of the modified immune cell is receiving or had previously received a hematopoietic cell transplant (HCT; including myeloablative and non-myeloablative HCT). Techniques and regimens for performing HCT are known in the art and can comprise transplantation of any suitable donor cell, such as a cell derived from umbilical cord blood, bone marrow, or peripheral blood, a hematopoietic stem cell, a mobilized stem cell, or a cell from amniotic fluid. Accordingly, in certain embodiments, a modified immune cell of the present disclosure can be administered with or shortly after hematopoietic stem cells in a modified HCT therapy. In some embodiments, the HCT comprises a donor hematopoieitic cell comprising a chromosomal knockout of a gene that encodes an HLA component, a chromosomal knockout of a gene that encodes a TCR component, or both.

In further embodiments, the subject had previously received lymphodepleting chemotherapy prior to receiving the composition or HCT. In certain embodiments, a lymphodepleting chemotherapy comprises a conditioning regimen comprising cyclophosphamide, fludarabine, anti-thymocyte globulin, or a combination thereof.

Methods according to this disclosure may further include administering one or more additional agents to treat the disease or disorder in a combination therapy. For example, in certain embodiments, a combination therapy comprises administering a composition of the present disclosure with (concurrently, simultaneously, or sequentially) an immune checkpoint inhibitor. In some embodiments, a combination therapy comprises administering a composition of the present disclosure with an agonist of a stimulatory immune checkpoint agent. In further embodiments, a combination therapy comprises administering a composition of the present disclosure with a secondary therapy, such as chemotherapeutic agent, a radiation therapy, a surgery, an antibody, or any combination thereof.

As used herein, the term "immune suppression agent" or "immunosuppression agent" refers to one or more cells, proteins, molecules, compounds or complexes providing inhibitory signals to assist in controlling or suppressing an immune response. For example, immune suppression agents include those molecules that partially or totally block immune stimulation; decrease, prevent or delay immune activation; or increase, activate, or up regulate immune suppression. Exemplary immunosuppression agents to target (e.g., with an immune checkpoint inhibitor) include PD-1, PD-L1, PD-L2, LAG3, CTLA4, B7-H3, B7-H4, CD244/2B4, HVEM, BTLA, CD160, TIM3, GA9L, KIR, PVR1G (CD112R), PVRL2, adenosine, A2aR, immunosuppressive cytokines (e.g., IL-10, IL-4, IL-1RA, IL-35), IDO, arginase, VISTA, TIGIT, LAIR1, CEACAM-1, CEACAM-3, CEACAM-5, Treg cells, or any combination thereof.

An immune suppression agent inhibitor (also referred to as an immune checkpoint inhibitor) may be a compound, an antibody, an antibody fragment or fusion polypeptide (e.g., Fc fusion, such as CTLA4-Fc or LAG3-Fc), an antisense molecule, a ribozyme or RNAi molecule, or a low molecular weight organic molecule. In any of the embodiments disclosed herein, a method may comprise a composition of the present disclosure with one or more inhibitor of any one of the following immune suppression components, singly or in any combination.

In certain embodiments, a composition of the present disclosure is used in combination with a PD-1 inhibitor, for example a PD-1-specific antibody or binding fragment thereof, such as pidilizumab, nivolumab, pembrolizumab, MEDI0680 (formerly AMP-514), AMP-224, BMS-936558 or any combination thereof. In further embodiments, a composition of the present disclosure is used in combination with a PD-L1 specific antibody or binding fragment thereof, such as BMS-936559, durvalumab (MEDI4736), atezolizumab (RG7446), avelumab (MSB0010718C), MPDL3280A, or any combination thereof. Also contemplated are cemiplimab; IBI-308; nivolumab+relatlimab; BCD-100; camrelizumab; JS-001; spartalizumab; tislelizumab; AGEN-2034; BGBA-333+tislelizumab; CBT-501; dostarlimab; durvalumab+MEDI-0680; JNJ-3283; pazopanib hydrochloride+pembrolizumab; pidilizumab; REGN-1979+cemiplimab; ABBV-181; ADUS-100+spartalizumab; AK-104; AK-105; AMP-224; BAT-1306; BI-754091; CC-90006; cemiplimab+REGN-3767; CS-1003; GLS-010; LZM-009; MEDI-5752; MGD-013; PF-06801591; Sym-021; tislelizumab+pamiparib; XmAb-20717; AK-112; ALPN-202; AM-0001; an antibody to antagonize PD-1 for Alzheimer's disease; BH-2922; BH-2941; BH-2950; BH-2954; a biologic to antagonize CTLA-4 and PD-1 for solid tumor; a bispecific monoclonal antibody to target PD-1 and LAG-3 for oncology; BLSM-101; CB-201; CB-213; CBT-103; CBT-107; a cellular immunotherapy+PD-1 inhibitor; CX-188; HAB-21; HEIS-COIII-003; IKT-202; JTX-4014; MCLA-134; MD-402; mDX-400; MGD-019; a monoclonal antibody to antagonize PDCD1 for oncology; a monoclonal antibody to antagonize PD-1 for oncology; an oncolytic virus to inhibit PD-1 for oncology; OT-2; PD-1 antagonist+ropeginterferon alfa-2b; PEGMP-7; PRS-332; RXI-762; STIA-1110; TSR-075; a vaccine to target HER2 and PD-1 for oncology; a vaccine to target PD-1 for oncology and autoimmune disorders; XmAb-23104; an antisense oligonucleotide to inhibit PD-1 for oncology; AT-16201; a bispecific monoclonal antibody to inhibit PD-1 for oncology; IMM-1802; monoclonal antibodies to antagonize PD-1 and CTLA-4 for solid tumor and hematological tumor; nivolumab biosimilar; a recombinant protein to agonize CD278 and CD28 and antagonize PD-1 for oncology; a recombinant protein to agonize PD-1 for autoimmune disorders and inflammatory disorders; SNA-01; SSI-361; YBL-006; AK-103; JY-034; AUR-012; BGB-108; drug to inhibit PD-1, Gal-9, and TIM-3 for solid tumor; ENUM-244C8; ENUM-388D4; MEDI-0680; monoclonal antibodies to antagonize PD-1 for metastatic melanoma and metastatic lung cancer; a monoclonal antibody to inhibit PD-1 for oncology; monoclonal antibodies to target CTLA-4 and PD-1 for oncology; a monoclonal antibody to antagonize PD-1 for NSCLC; monoclonal antibodies to inhibit PD-1 and TIM-3 for oncology; a monoclonal antibody to inhibit PD-1 for oncology; a recombinant protein to inhibit PD-1 and VEGF-A for hematological malignancies and solid tumor; a small molecule to antagonize PD-1 for oncology; Sym-016; inebilizumab+MEDI-0680; a vaccine to target PDL-1 and IDO for metastatic melanoma; an anti-PD-1 monoclonal antibody plus a cellular immunotherapy for glioblastoma; an antibody to antagonize PD-1 for oncology; monoclonal antibodies to inhibit PD-1/PD-L1 for hematological malignancies and bacterial infections; a monoclonal antibody to inhibit PD-1 for HIV; or a small molecule to inhibit PD-1 for solid tumor.

In certain embodiments, a composition of the present disclosure of the present disclosure is used in combination with a LAG3 inhibitor, such as LAG525, IMP321, IMP701, 9H12, BMS-986016, or any combination thereof.

In certain embodiments, a composition of the present disclosure is used in combination with an inhibitor of CTLA4. In particular embodiments, a composition of the present disclosure is used in combination with a CTLA4 specific antibody or binding fragment thereof, such as ipilimumab, tremelimumab, CTLA4-Ig fusion proteins (e.g., abatacept, belatacept), or any combination thereof.

In certain embodiments, a composition of the present disclosure is used in combination with a B7-H3 specific antibody or binding fragment thereof, such as enoblituzumab (MGA271), 376.96, or both. A B7-H4 antibody binding fragment may be a scFv or fusion protein thereof, as described in, for example, Dangaj et al., Cancer Res. 73:4820, 2013, as well as those described in U.S. Pat. No. 9,574,000 and PCT Patent Publication Nos. WO/201640724A1 and WO 2013/025779A1.

In certain embodiments, a composition of the present disclosure is used in combination with an inhibitor of CD244.

In certain embodiments, a composition of the present disclosure is used in combination with an inhibitor of BLTA, HVEM, CD160, or any combination thereof. Anti CD-160 antibodies are described in, for example, PCT Publication No. WO 2010/084158.

In certain embodiments, a composition of the present disclosure cell is used in combination with an inhibitor of TIM3.

In certain embodiments, a composition of the present disclosure is used in combination with an inhibitor of Gal9.

In certain embodiments, a composition of the present disclosure is used in combination with an inhibitor of adenosine signaling, such as a decoy adenosine receptor.

In certain embodiments, a composition of the present disclosure is used in combination with an inhibitor of A2aR.

In certain embodiments, a composition of the present disclosure is used in combination with an inhibitor of KIR, such as lirilumab (BMS-986015).

In certain embodiments, a composition of the present disclosure is used in combination with an inhibitor of an inhibitory cytokine (typically, a cytokine other than TGFβ) or Treg development or activity.

In certain embodiments, a composition of the present disclosure is used in combination with an IDO inhibitor, such as levo-1-methyl tryptophan, epacadostat (INCB024360; Liu et al., Blood 115:3520-30, 2010), ebselen (Terentis et al., Biochem. 49:591-600, 2010), indoximod, NLG919 (Mautino et al., American Association for Cancer Research 104th Annual Meeting 2013; Apr. 6-10, 2013), 1-methyl-tryptophan (1-MT)-tira-pazamine, or any combination thereof.

In certain embodiments, a composition of the present disclosure is used in combination with an arginase inhibitor, such as N(omega)-Nitro-L-arginine methyl ester (L-NAME), N-omega-hydroxy-nor-1-arginine (nor-NOHA), L-NOHA, 2(S)-amino-6-boronohexanoic acid (ABH), S-(2-boronoethyl)-L-cysteine (BEC), or any combination thereof.

In certain embodiments, a composition of the present disclosure is used in combination with an inhibitor of VISTA, such as CA-170 (Curis, Lexington, Mass.).

In certain embodiments, a composition of the present disclosure is used in combination with an inhibitor of TIGIT such as, for example, COM902 (Compugen, Toronto, Ontario Canada), an inhibitor of CD155, such as, for example, COM701 (Compugen), or both.

In certain embodiments, a composition of the present disclosure is used in combination with an inhibitor of PVRIG, PVRL2, or both. Anti-PVRIG antibodies are described in, for example, PCT Publication No. WO 2016/134333. Anti-PVRL2 antibodies are described in, for example, PCT Publication No. WO 2017/021526.

In certain embodiments, a composition of the present disclosure is used in combination with a LAIR1 inhibitor.

In certain embodiments, a composition of the present disclosure is used in combination with an inhibitor of CEACAM-1, CEACAM-3, CEACAM-5, or any combination thereof.

In certain embodiments, a composition of the present disclosure is used in combination with an agent that increases the activity (i.e., is an agonist) of a stimulatory immune checkpoint molecule. For example a composition of the present disclosure can be used in combination with a CD137 (4-1BB) agonist (such as, for example, urelumab), a CD134 (OX-40) agonist (such as, for example, MEDI6469, MEDI6383, or MEDI0562), lenalidomide, pomalidomide, a CD27 agonist (such as, for example, CDX-1127), a CD28 agonist (such as, for example, TGN1412, CD80, or CD86), a CD40 agonist (such as, for example, CP-870,893, rhuCD40L, or SGN-40), a CD122 agonist (such as, for example, IL-2) an agonist of GITR (such as, for example, humanized monoclonal antibodies described in PCT Patent Publication No. WO 2016/054638), an agonist of ICOS (CD278) (such as, for example, GSK3359609, mAb 88.2, JTX-2011, Icos 145-1, Icos 314-8, or any combination thereof). In any of the embodiments disclosed herein, a method may comprise administering a composition of the present disclosure with one or more agonist of a stimulatory immune checkpoint molecule, including any of the foregoing, singly or in any combination.

In certain embodiments, a combination therapy comprises a composition of the present disclosure and a secondary therapy comprising one or more of: an antibody or antigen binding-fragment thereof that is specific for a cancer antigen expressed by the non-inflamed solid tumor, a radiation treatment, a surgery, a chemotherapeutic agent, a cytokine, RNAi, or any combination thereof.

In certain embodiments, a combination therapy method comprises administering a composition of the present disclosure and further administering a radiation treatment or a surgery. Radiation therapy is well-known in the art and includes X-ray therapies, such as gamma-irradiation, and radiopharmaceutical therapies. Surgeries and surgical techniques appropriate to treating a given cancer in a subject are well-known to those of ordinary skill in the art.

In certain embodiments, a combination therapy method comprises administering a composition of the present disclosure and further administering a chemotherapeutic agent. A chemotherapeutic agent includes, but is not limited to, an inhibitor of chromatin function, a topoisomerase inhibitor, a microtubule inhibiting drug, a DNA damaging agent, an antimetabolite (such as folate antagonists, pyrimidine analogs, purine analogs, and sugar-modified analogs), a DNA synthesis inhibitor, a DNA interactive agent (such as an intercalating agent), and a DNA repair inhibitor. Illustrative chemotherapeutic agents include, without limitation, the following groups: anti-metabolites/anti-cancer agents, such as pyrimidine analogs (5-fluorouracil, floxuridine, capecitabine, gemcitabine and cytarabine) and purine analogs, folate antagonists and related inhibitors (mercaptopurine, thioguanine, pentostatin and 2-chlorodeoxyadenosine (cladribine)); antiproliferative/antimitotic agents including natural products such as vinca alkaloids (vinblastine, vincristine, and vinorelbine), microtubule disruptors such as taxane (paclitaxel, docetaxel), vincristin, vinblastin, nocodazole, epothilones and navelbine, epidipodophyllotoxins (etoposide, teniposide), DNA damaging agents (actinomycin, amsacrine, anthracyclines, bleomycin, busulfan, camptothecin, carboplatin, chlorambucil, cisplatin, cyclophosphamide, Cytoxan, dactinomycin, daunorubicin, doxorubicin, epirubicin, hexamethylmelamineoxaliplatin, iphosphamide, melphalan, merchlorehtamine, mitomycin, mitoxantrone, nitrosourea, plicamycin, procarbazine, taxol, taxotere, temozolamide, teniposide, triethylenethiophosphoramide and etoposide (VP 16)); antibiotics such as dactinomycin (actinomycin D), daunorubicin, doxorubicin (adriamycin), idarubicin, anthracyclines, mitoxantrone, bleomycins, plicamycin (mithramycin) and mitomycin; enzymes (L-asparaginase which systemically metabolizes L-asparagine and deprives cells which do not have the capacity to synthesize their own asparagine); antiplatelet agents; antiproliferative/antimitotic alkylating agents such as nitrogen mustards (mechlorethamine, cyclophosphamide and analogs, melphalan, chlorambucil), ethylenimines and methylmelamines (hexamethylmelamine and thiotepa), alkyl sulfonates-busulfan, nitrosoureas (carmustine (BCNU) and analogs, streptozocin), trazenes-dacarbazinine (DTIC); antiproliferative/antimitotic antimetabolites such as folic acid analogs (methotrexate); platinum coordination complexes (cisplatin, carboplatin), procarbazine, hydroxyurea, mitotane, aminoglutethimide; hormones, hormone analogs (estrogen, tamoxifen, goserelin, bicalutamide, nilutamide) and aromatase inhibitors (letrozole, anastrozole); anticoagulants (heparin, synthetic heparin salts and other inhibitors of thrombin); fibrinolytic agents (such as tissue plasminogen activator, streptokinase and urokinase), aspirin, dipyridamole, ticlopidine, clopidogrel, abciximab; antimigratory agents; antisecretory agents (breveldin); immunosuppressives (cyclosporine, tacrolimus (FK-506), sirolimus (rapamycin), azathioprine, mycophenolate mofetil); anti-angiogenic compounds (TNP470, genistein) and growth factor inhibitors (vascular endothelial growth factor (VEGF) inhibitors, fibroblast growth factor (FGF) inhibitors); angiotensin receptor blocker; nitric oxide donors; antisense oligonucleotides; antibodies (trastuzumab, rituximab); chimeric antigen receptors; cell cycle inhibitors and differentiation inducers (tretinoin); mTOR inhibitors, topoisomerase inhibitors (doxorubicin (adriamycin), amsacrine, camptothecin, daunorubicin, dactinomycin, eniposide, epirubicin, etoposide, idarubicin, irinotecan (CPT-11) and mitoxantrone, topotecan, irinotecan), corticosteroids (cortisone, dexamethasone, hydrocortisone, methylpednisolone, prednisone, and prenisolone); growth factor signal transduction kinase inhibitors; mitochondrial dysfunction inducers, toxins such as Cholera toxin, ricin, *Pseudomonas* exotoxin, *Bordetella pertussis* adenylate cyclase toxin, or diphtheria toxin, and caspase activators; and chromatin disruptors.

Cytokines may be used to manipulate host immune response towards anticancer activity. See, e.g., Floros & Tarhini, *Semin. Oncol.* 42(4):539-548, 2015. Cytokines useful for promoting immune anticancer or antitumor response include, for example, IFN-α, IL-2, IL-3, IL-4, IL-10, IL-12, IL-13, IL-15, IL-16, IL-17, IL-18, IL-21, IL-24, and GM-CSF, singly or in any combination with a composition of the present disclosure.

Also provided herein are methods for modulating an adoptive immunotherapy, wherein the methods comprise administering, to a subject who has previously received a modified host cell of the present disclosure that comprises a heterologous polynucleotide encoding a safety switch protein, a cognate compound of the safety switch protein in an amount effective to ablate in the subject the previously administered modified host cell.

In certain embodiments, the safety switch protein comprises tEGFR and the cognate compound is cetuximab, or the safety switch protein comprises iCasp9 and the cognate compound is AP1903 (e.g., dimerized AP1903), or the safety switch protein comprises a RQR polypeptide and the cognate compound is rituximab, or the safety switch protein comprises a myc binding domain and the cognate compound is an antibody specific for the myc binding domain.

In still further aspects, methods are provided for manufacturing a composition, or a unit dose of the present disclosure. In certain embodiments, the methods comprise combining (i) an aliquot of a host cell transduced with a vector of the present disclosure with (ii) a pharmaceutically acceptable carrier. In certain embodiments, vectors of the present disclosure are used to transfect/transduce a host cell (e.g., a T cell) for use in adoptive transfer therapy (e.g., targeting a cancer antigen).

In some embodiments, the methods further comprise, prior to the aliquotting, culturing the transduced host cell and selecting the transduced cell as having incorporated (i.e., expressing) the vector. In further embodiments, the methods comprise, following the culturing and selection and prior to the aliquotting, expanding the transduced host cell. In any of the embodiments of the instant methods, the manufactured composition or unit dose may be frozen for later use. Any appropriate host cell can be used for manufacturing a composition or unit dose according to the instant methods, including, for example, a hematopoietic stem cell, a T cell, a primary T cell, a T cell line, a NK cell, or a NK-T cell. In specific embodiments, the methods comprise a host cell which is a CD8+ T cell, a CD4+ T cell, or both.

Also provided are methods for inducing an immune response in a subject, the method comprising administering to the subject an immunogenic polypeptide comprising or consisting of the amino acid sequence set forth in any one of SEQ ID NOs:198-201.

Also provided are methods for preparing antigen-pulsed antigen-presenting cells, the method comprising: contacting in vitro, under conditions and for a time sufficient for antigen processing and presentation by antigen-presenting cells to take place, (i) a population of antigen-presenting cells, and (ii) a Ras peptide of the present disclosure (e.g., SEQ ID NO.:198-201) or a polynucleotide encoding the same, thereby obtaining antigen-pulsed antigen-presenting cells capable of eliciting an antigen-specific T-cell response to against the Ras peptide. In some embodiments, the method further comprises contacting the antigen-pulsed antigen-presenting cells with one or a plurality of immunocompatible T cells under conditions and for a time sufficient to generate Ras peptide-specific T cells.

Also provided are any of the binding proteins, polynucleotides, expression vectors, host cells, host cell compositions, unit doses, and immunogenic polypeptides, taken singly or in any combination, for use in treating a disease or disorder associated with a KRAS G12D mutation or a KRAS G12V or a NRAS G12D mutation or a NRAS G12V mutation or a HRAS G12V mutation or a HRAS G12D mutation in a subject.

Also provided are any of the binding proteins, polynucleotides, expression vectors, host cells, host cell compositions, unit doses, and immunogenic polypeptides, taken singly or in any combination, for use the manufacture of a medicament for treating a disease or disorder associated with a KRAS G12D mutation or a KRAS G12V or a NRAS G12D mutation or a NRAS G12V mutation or a HRAS G12V mutation or a HRAS G12D mutation in a subject.

In certain embodiments, the disease or disorder comprises a cancer. In some embodiments, the cancer is a solid cancer or a hematological malignancy. In certain embodiments, the disease or disorder is selected from a pancreas cancer or carcinoma, optionally a pancreatic ductal adenocarcinoma (PDAC); a colorectal cancer or carcinoma; a lung cancer, optionally a non-small-cell lung carcinoma; a biliary cancer; an endometrial cancer or carcinoma; a cervical cancer; an ovarian cancer; a bladder cancer; a liver cancer; a myeloid leukemia, optionally myeloid leukemia such as acute myeloid leukemia; a myelodysplastic syndrome; a lymphoma such as Non-Hodgkin lymphoma; Chronic Melyomonocytic Leukemia; Acute Lymphoblastic Leukemia (ALL); a cancer of the urinary tract; a cancer of the small intestine; a breast cancer or carcinoma; a melanoma (optionally a cutaneous melanoma, an anal melanoma, or a mucosal melanoma); a glioma; a poorly differentiated thyroid gland carcinoma; a neuroblastoma; a histiocytic and dendritic cell neoplasm; neurofibromatisis Type 1; rhabdomyosarcoma; a soft tissue sarcoma; a bladder carcinoma; a sarcoma; a glioblastoma; a squamous cell lung carcinoma; an anaplastic astrocytoma; chronic myeloid leukemia; diffuse large B-cell lymphoma; double-hit lymphpoma; head and neck carcinoma; head and neck squamous cell carcinoma; hepatocellular carcinoma; malignant peripheral nerve sheath tumor; mantle cell lymphoma; myelodyspastic/myeloproliferative neoplasm, unclassifiable; peripheral T cell lymphoma; prostate carcinoma; refractory anemia with excess blasts-2; renal cell carcinoma; rhabdoid tumor; schwannoma; secondary AML; small cell lung carcinoma; therapy-related AML; thymic carcinoma; thyroid gland follyicular carcinoma; malignant thyroid gland neoplasm; thyroid gland carcinoma; thyroid gland adenocarcinoma; urothelial carcinoma; or thyroid gland papillary carcinoma. In some embodiments, the method comprises parenteral or intravenous administration of the subject composition. In some embodiments, the method comprises administering a plurality of doses of the binding protein, polynucleotide, expression vector, host cell, host cell composition, unit dose, and/or immunogenic polypeptide the subject.

In certain embodiments, the plurality of doses are administered at intervals between administrations of about two to about four weeks.

In certain embodiments, the composition comprises the modified host cell. In some embodiments, the method comprises administering the modified host cell to the subject at a dose of about $10^4$ cells/kg to about $10^{11}$ cells/kg.

In particular embodiments, a method comprises administering: (i) a composition comprising modified CD8+ and/or modified CD4+ T cells that comprise a heterologous polynucleotide encoding a binding protein according to any one of claims 1-26, when the subject expresses HLA-A*02:01; and/or (ii) a composition comprising modified CD8+ and/or modified CD4+ T cells that comprise a heterologous polynucleotide encoding a binding protein according to any one of claims 27-50, when the subject expresses HLA-A*11:01, wherein if both the composition of (i) and the composition of (ii) are administered, the composition of (i) and the composition of (ii) are comprised in the same composition or are administered as separate compositions.

In certain embodiments, wherein the method further comprises administering a cytokine to the subject. In some embodiments, the cytokine comprises IL-2, IL-15, or IL-21.

In certain embodiments, the subject has received or is receiving an immune checkpoint inhibitor and/or an agonist of a stimulatory immune checkpoint agent.

EXAMPLES

Example 1

Generation and Characterization of TCRs Specific for Mutant KRAS:HLA-A*11:01

Figure 2:
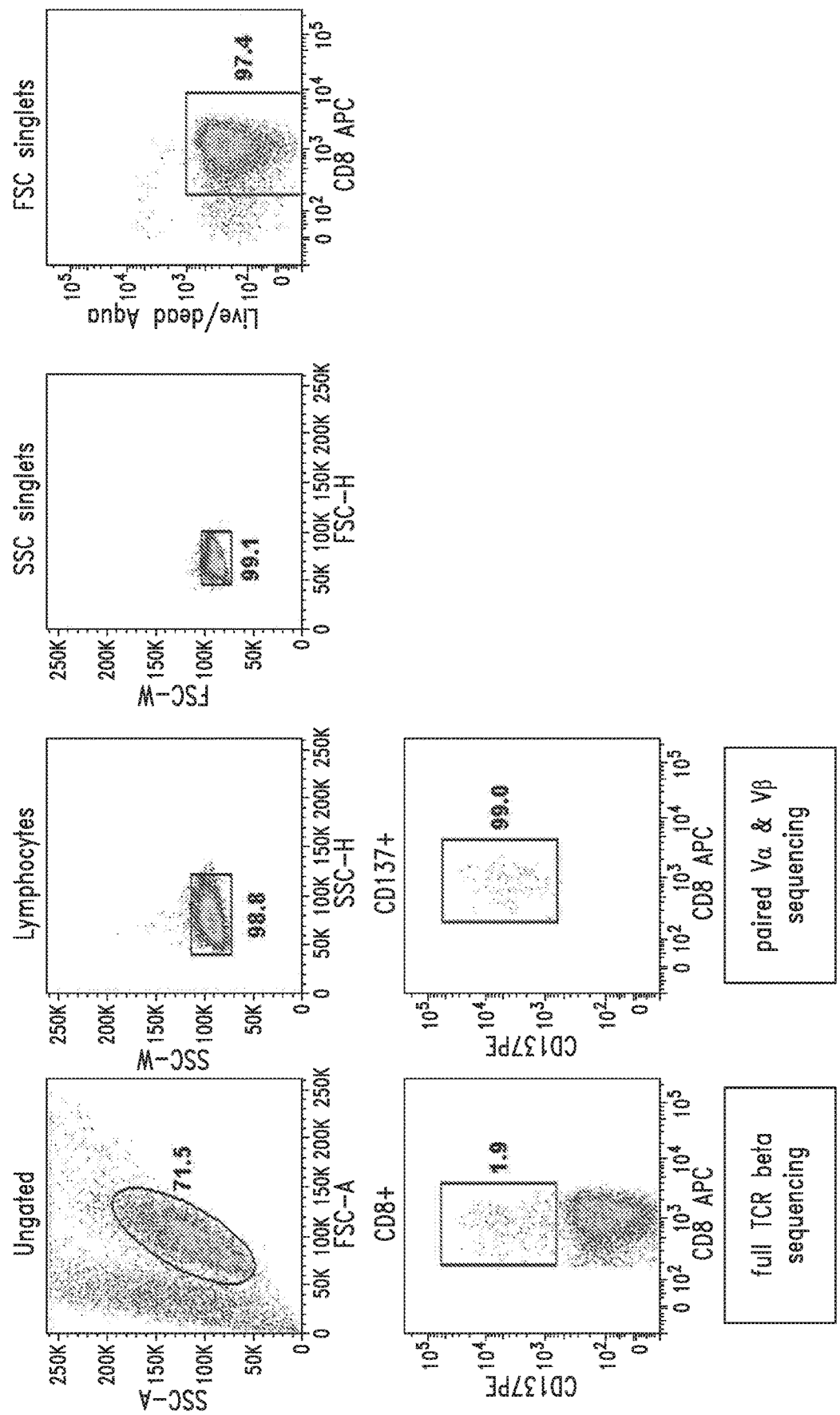

T cell lines from 2 healthy donors were stimulated 3× with mixed KRAS mutant peptides and incubated for 4 h with antigen-presenting cells (APCs) loaded with mutated KRAS peptides in the presence of Golgi inhibitors. Cytokine production (IFN-γ and TNFα) was measured by flow cytometry. Data are shown in FIG. 1. 30 HLA-A11/KRAS-specific T cell lines from 3 different donors were stimulated for 16 h with mixed KRAS mutant peptides at 100 ng/ml, then pooled and sorted on CD137 expression. Data are shown in FIG. 2. Genes encoding full TCRβ chains (Adaptive Biotechnologies, Seattle, Wash.) or paired Vα and Vβ domains (10× Genomics, Pleasanton, Calif.) were sequenced.

Figure 3:
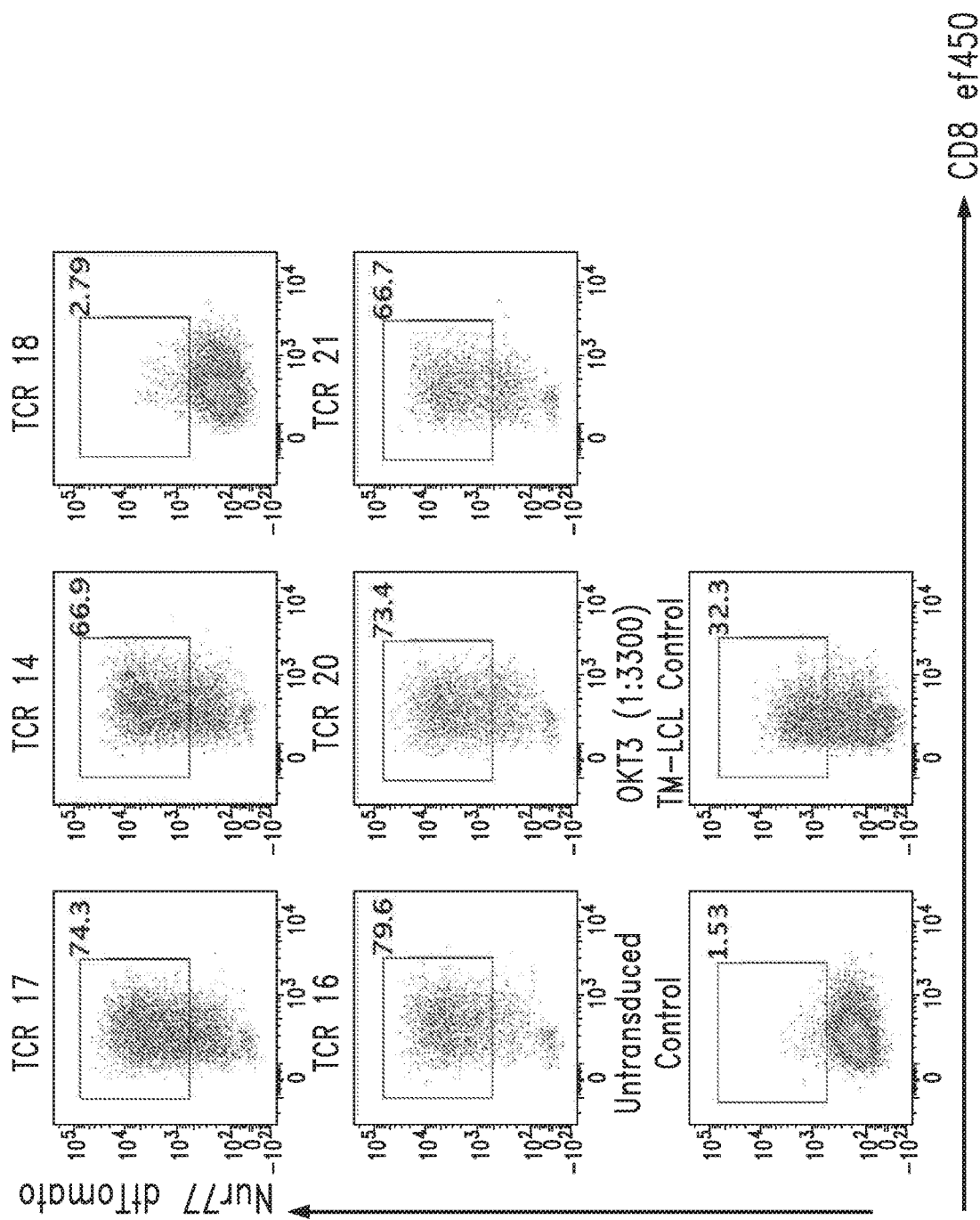
Figure 3:
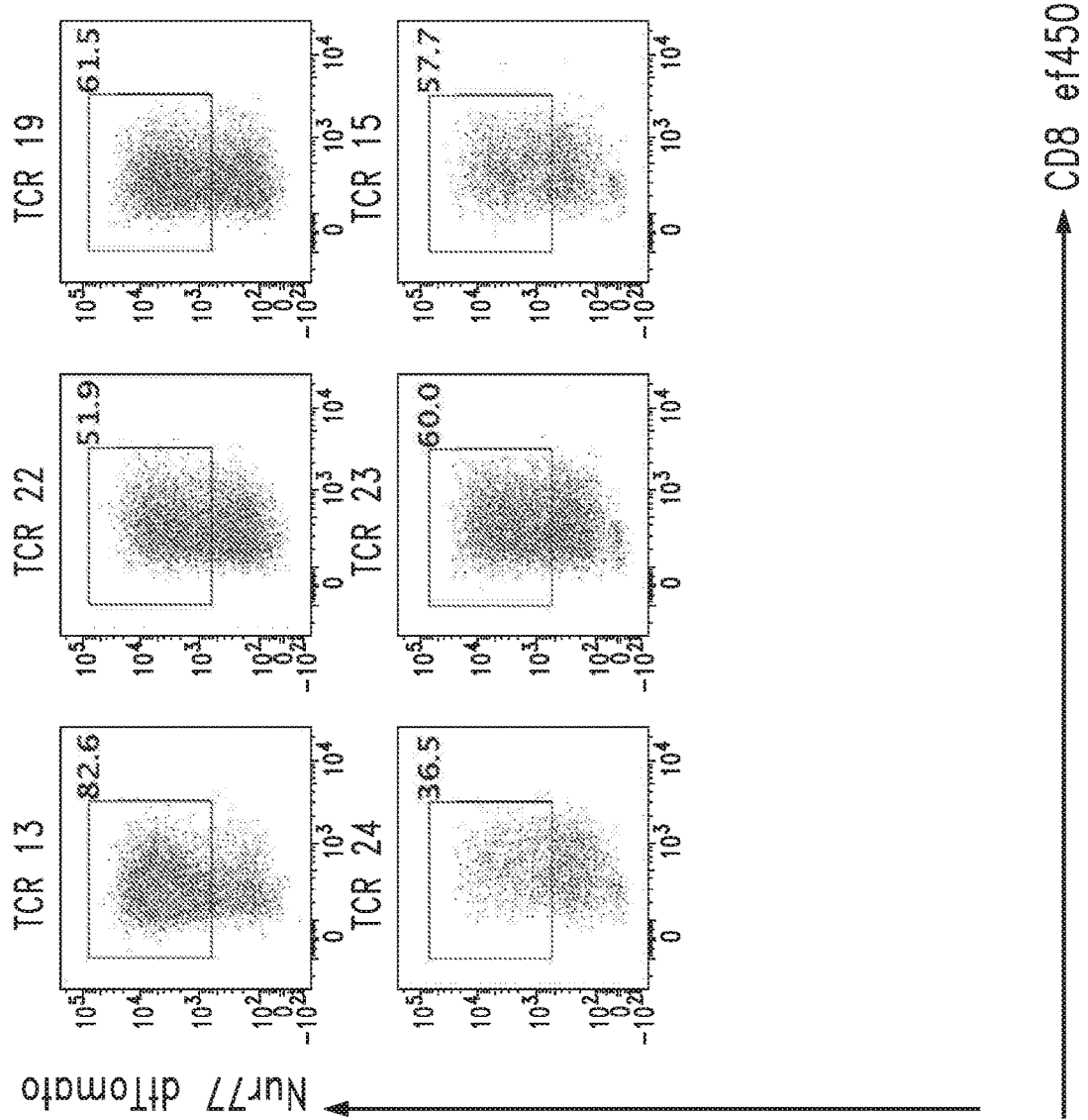
Figure 4A:
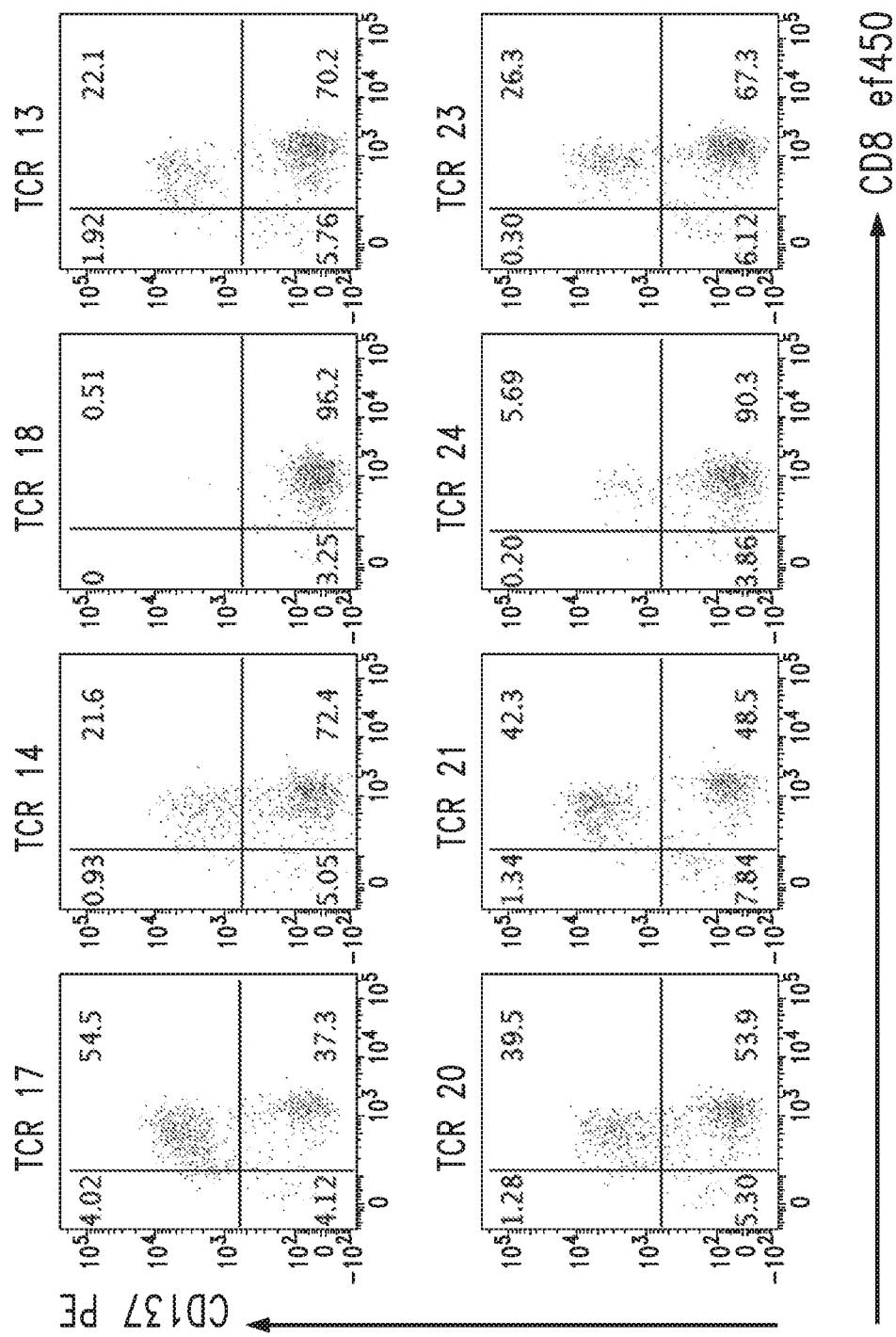
Figure 4A:
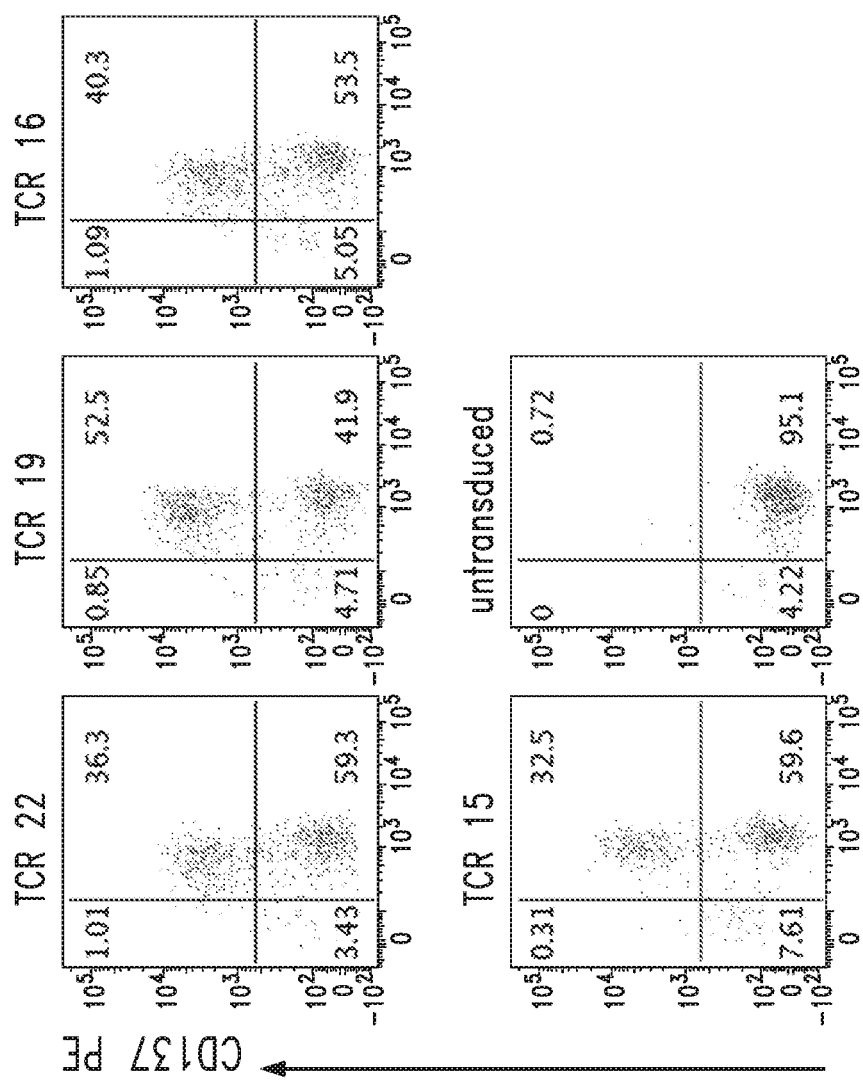
Figure 5A:
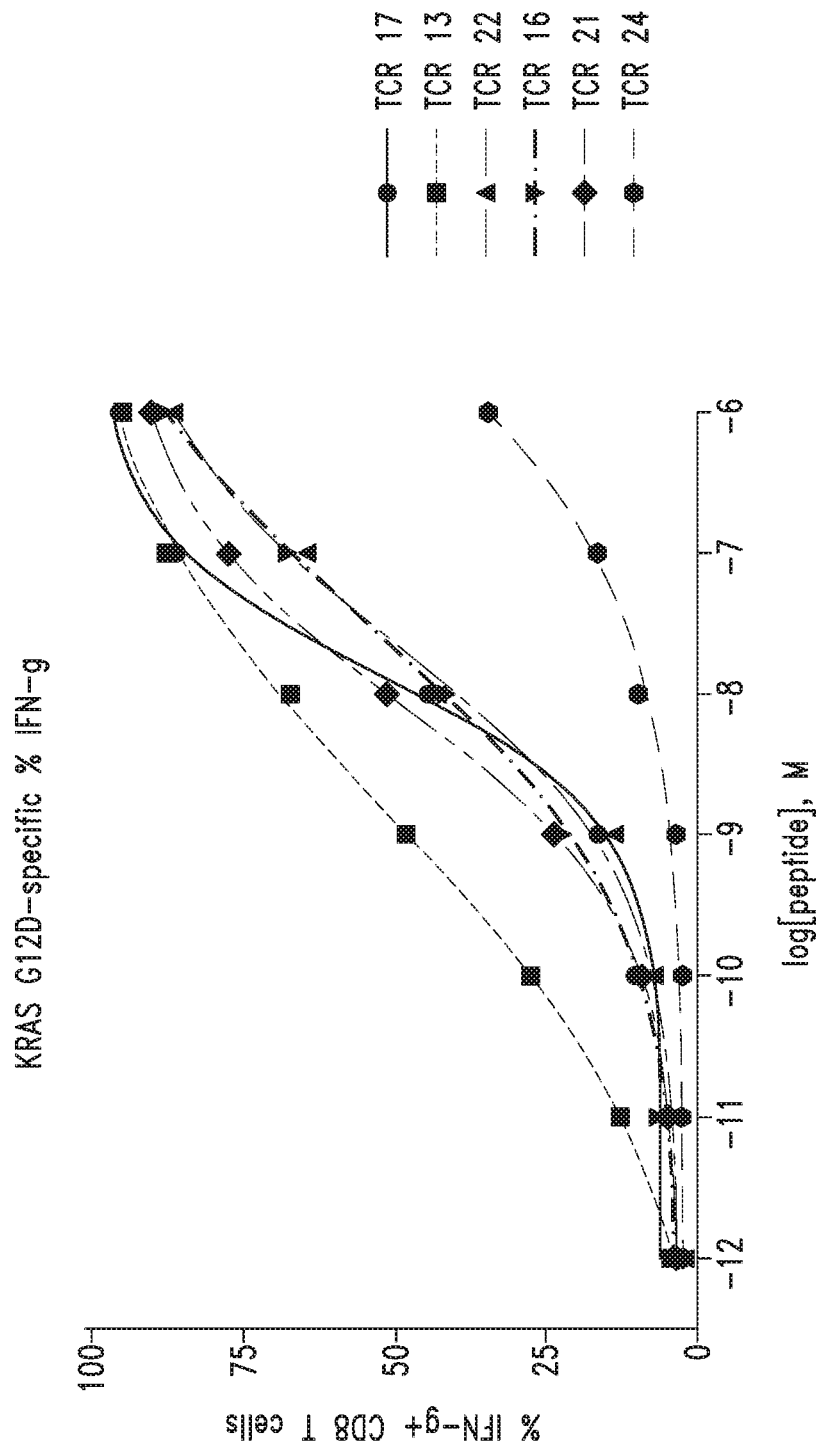
FIGS. 5A-5D show functional characterization of exemplary HLA-A11/KRAS-G12D-specific and -G12V-specific TCRs. (A) IFN-γ release by primary CD8$^+$ T cells transduced to express the indicated HLA-A11/KRAS-G12D-specific TCRs and stimulated with peptide antigen at increasing concentrations. (B) Functional avidity (log EC50 using KRAS G12D) values of the TCRs shown in (A). (C) IFN-γ release by primary CD8$^+$ T cells transduced to express the indicated HLA-A11/KRAS-G12V-specific TCRs and stimulated with peptide antigen at increasing concentrations. (D) Functional avidity (log EC50 using KRAS G12V) values of the TCRs shown in (C).
Figure 5B:
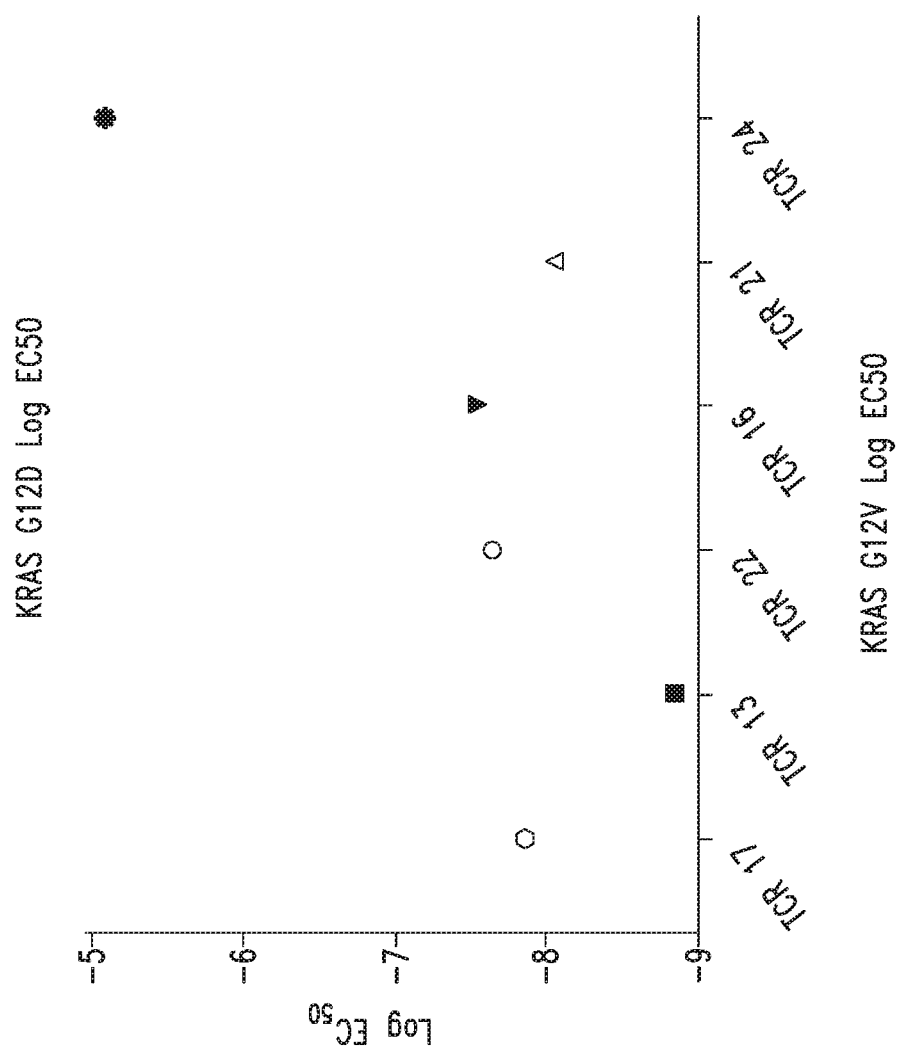
Figure 5C:
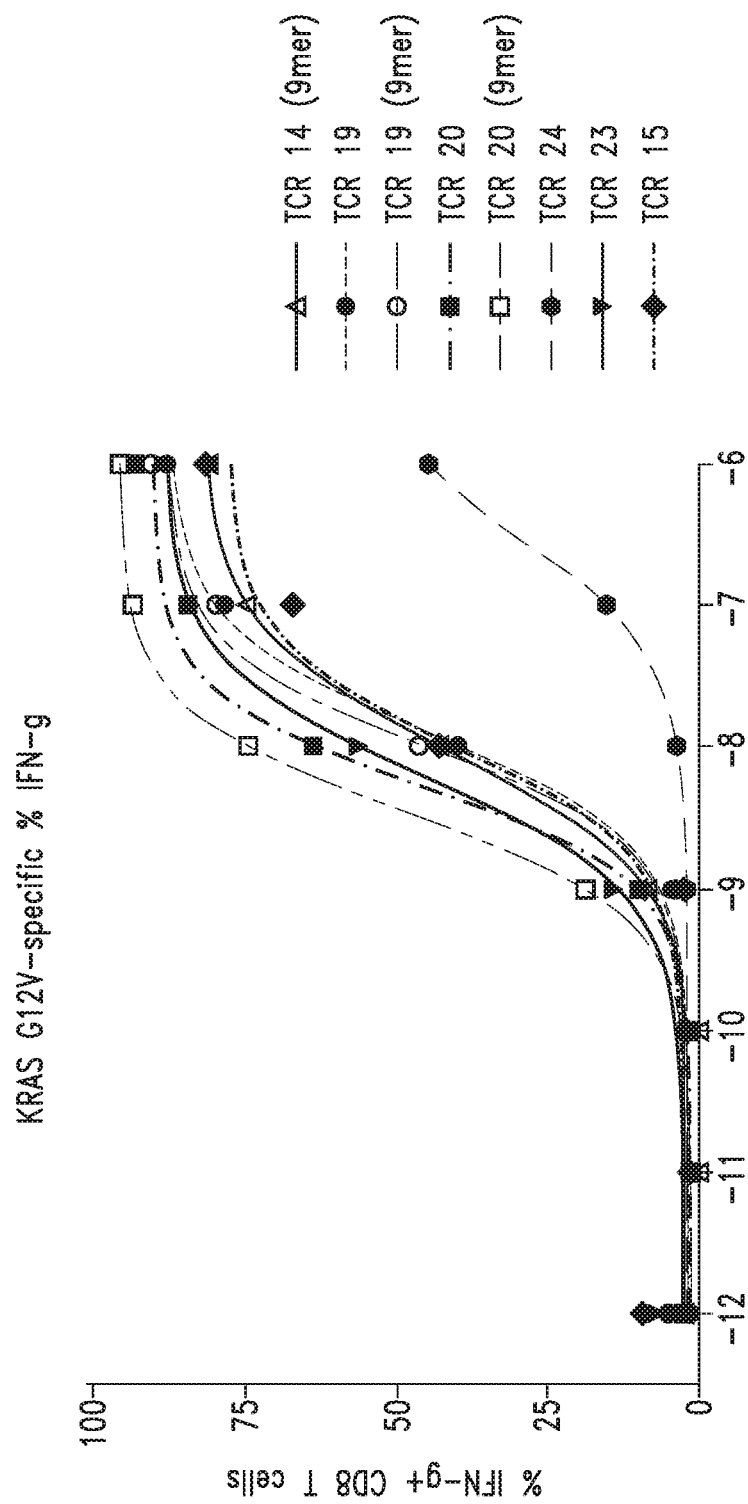
Figure 5D:
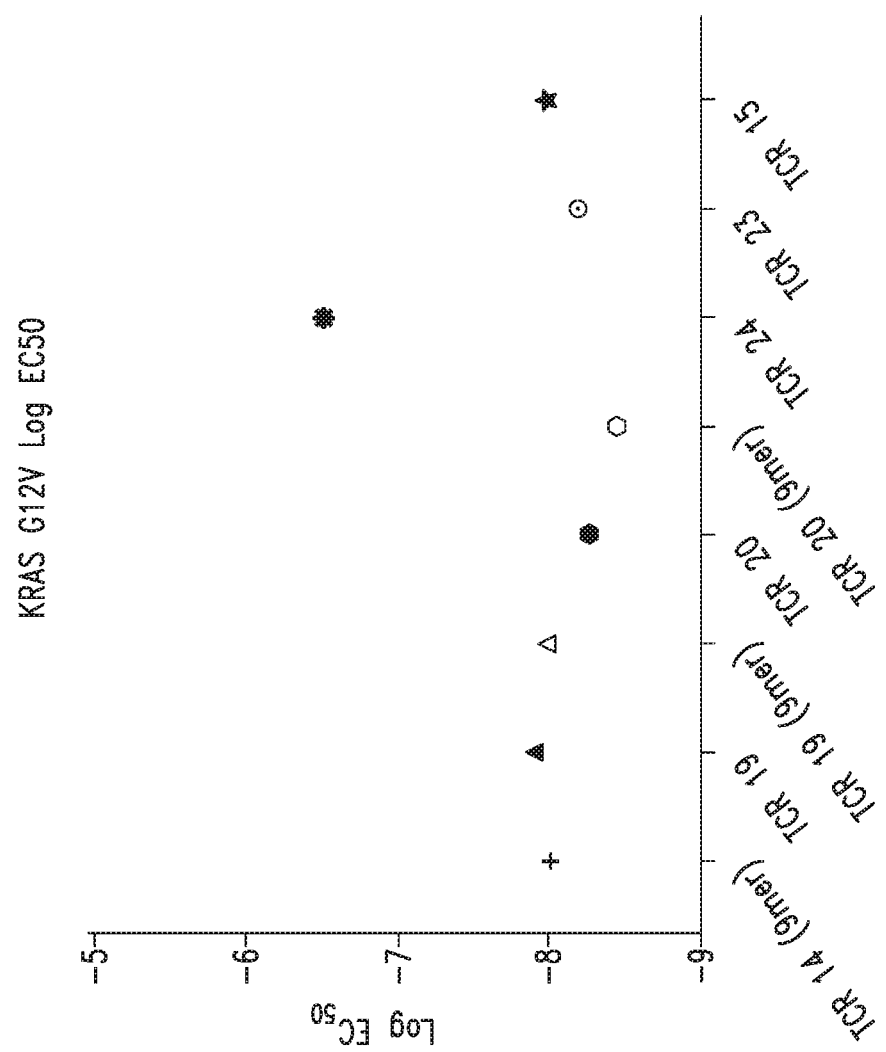
Figure 6A:
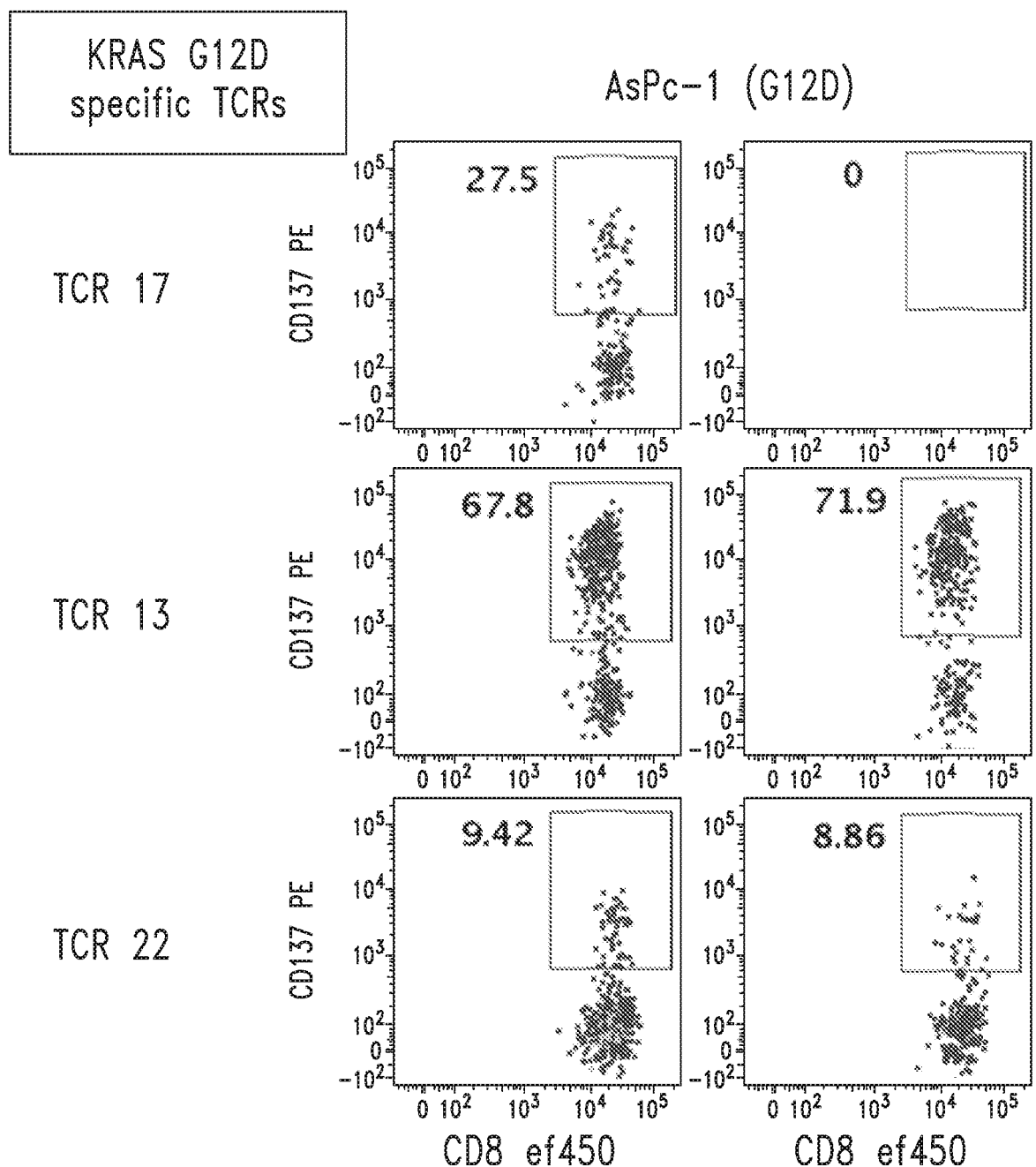
FIGS. 6A-6G show that exemplary HLA-A11 KRAS G12D mutation-specific TCRs respond to KRAS G12D$^+$ pancreatic cancer cell lines, as well as to an NRAS G12D$^+$ AML cell line (THP-1).
Figure 6A:
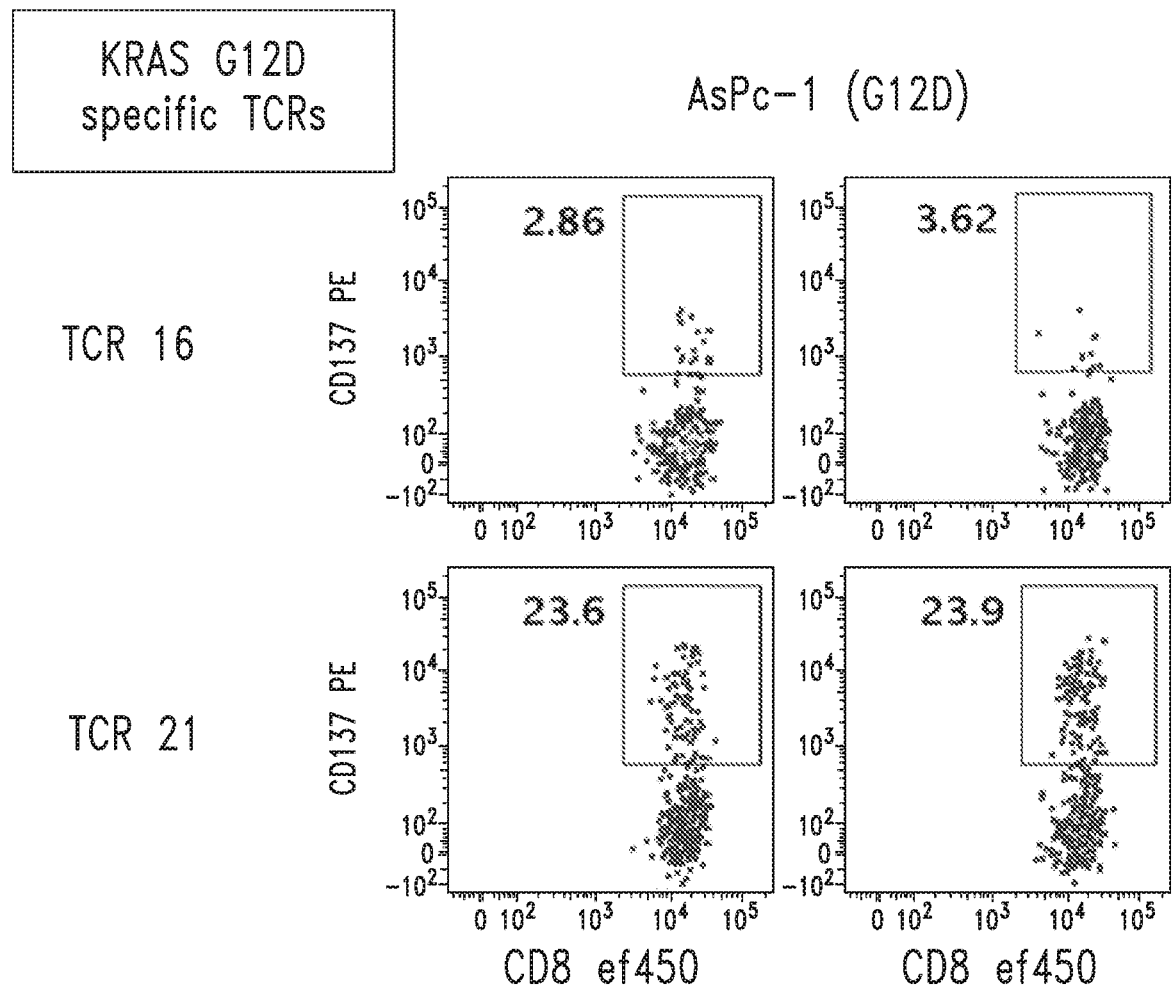
Figure 6B:
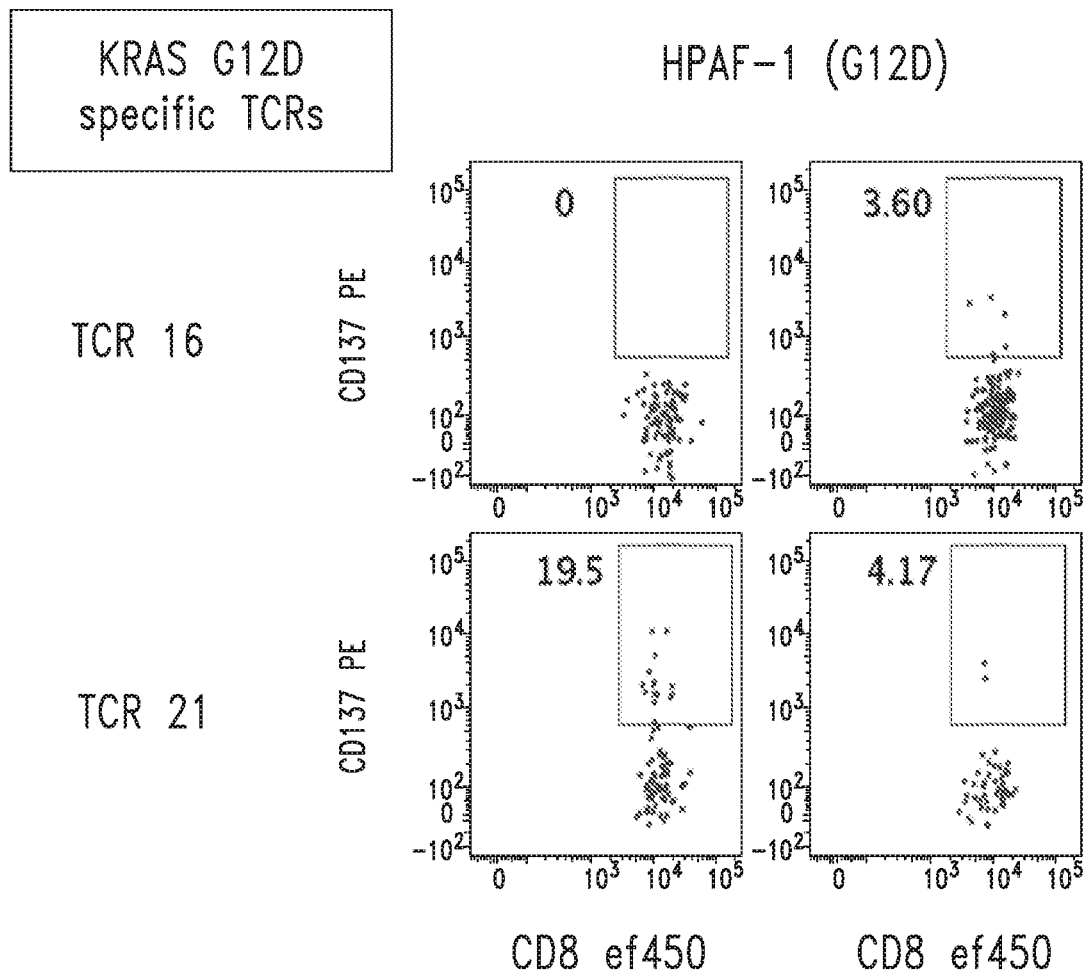
Figure 6C:
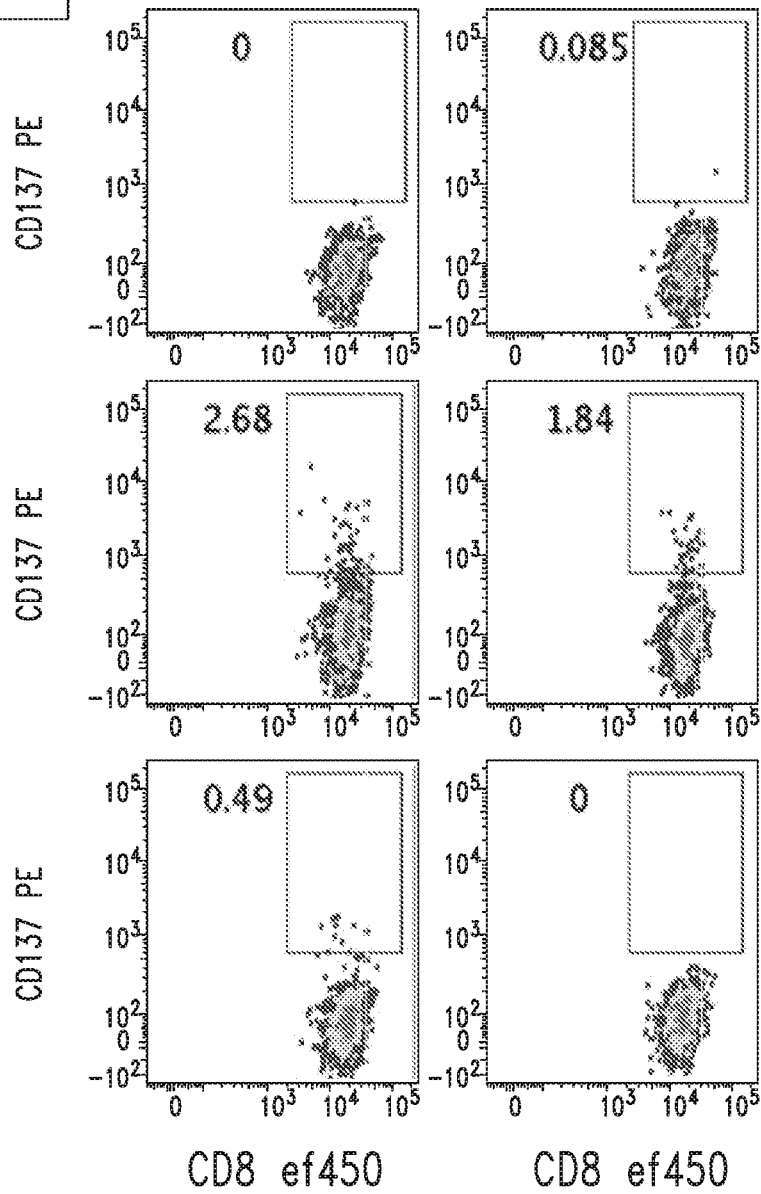
Figure 6C:
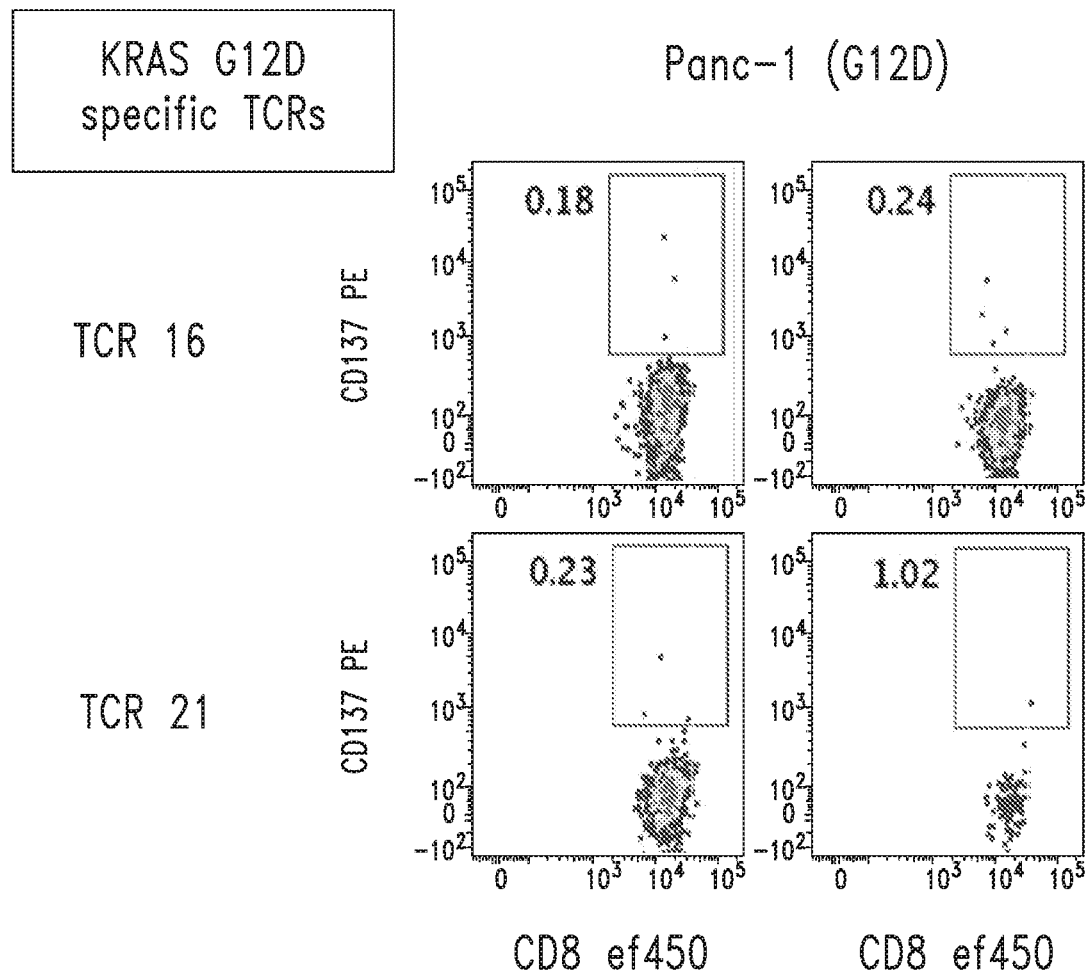
Figure 6D:
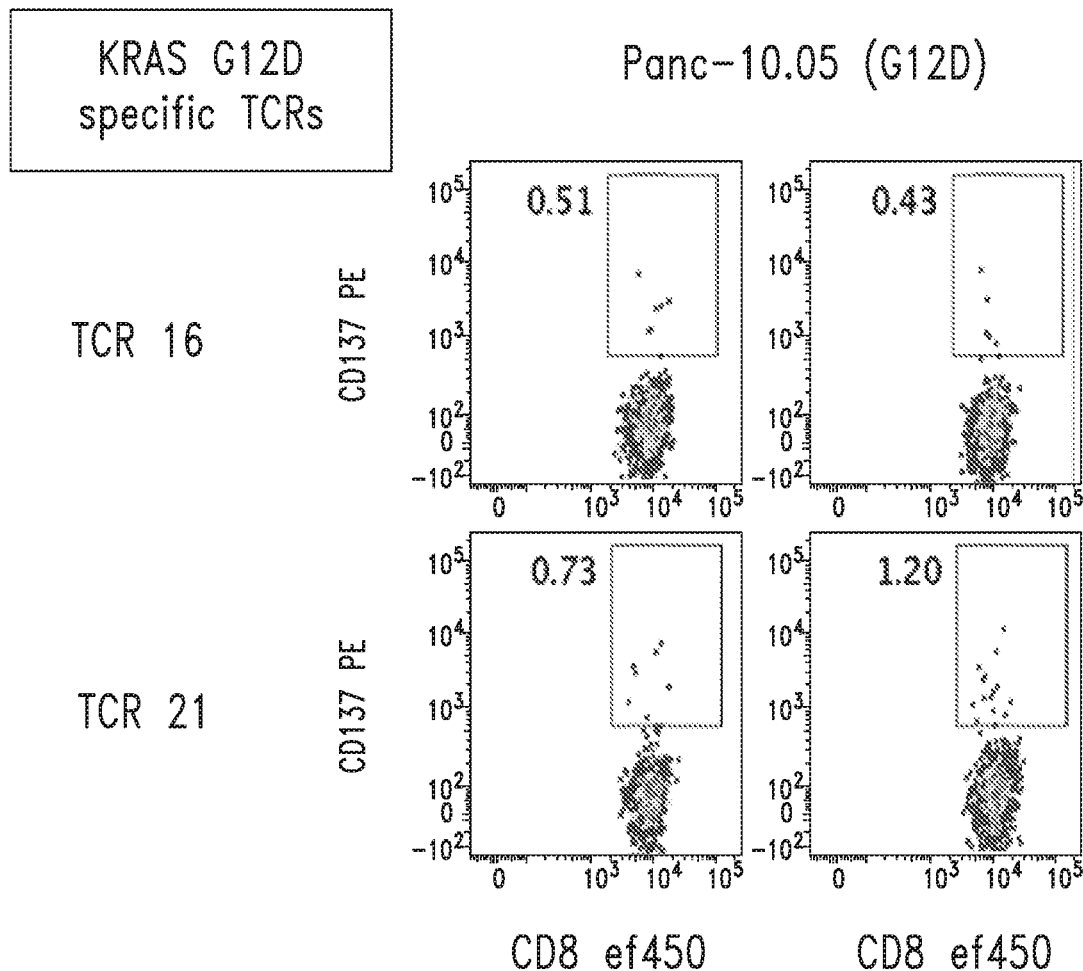
Figure 6E:
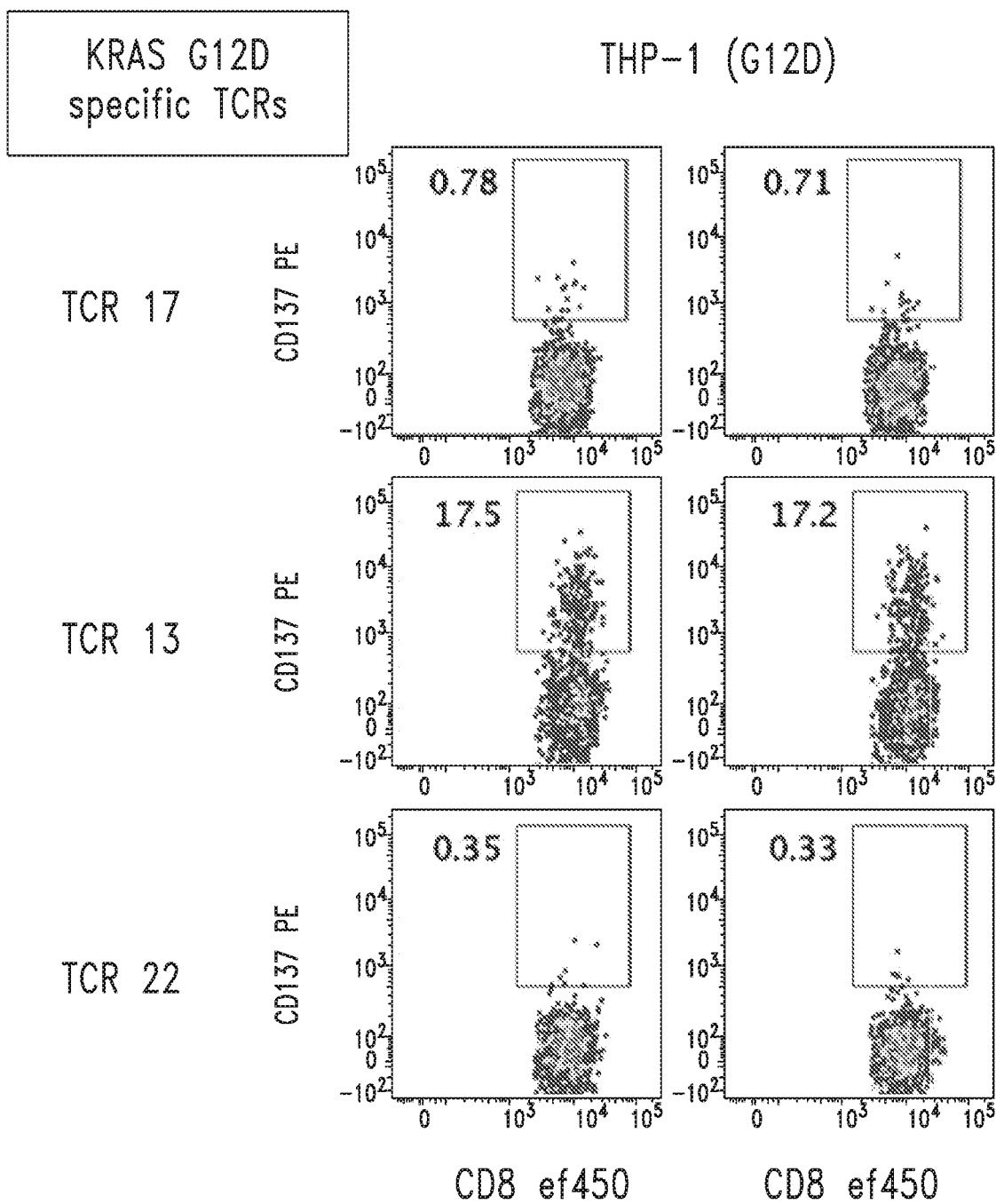
Figure 6E:
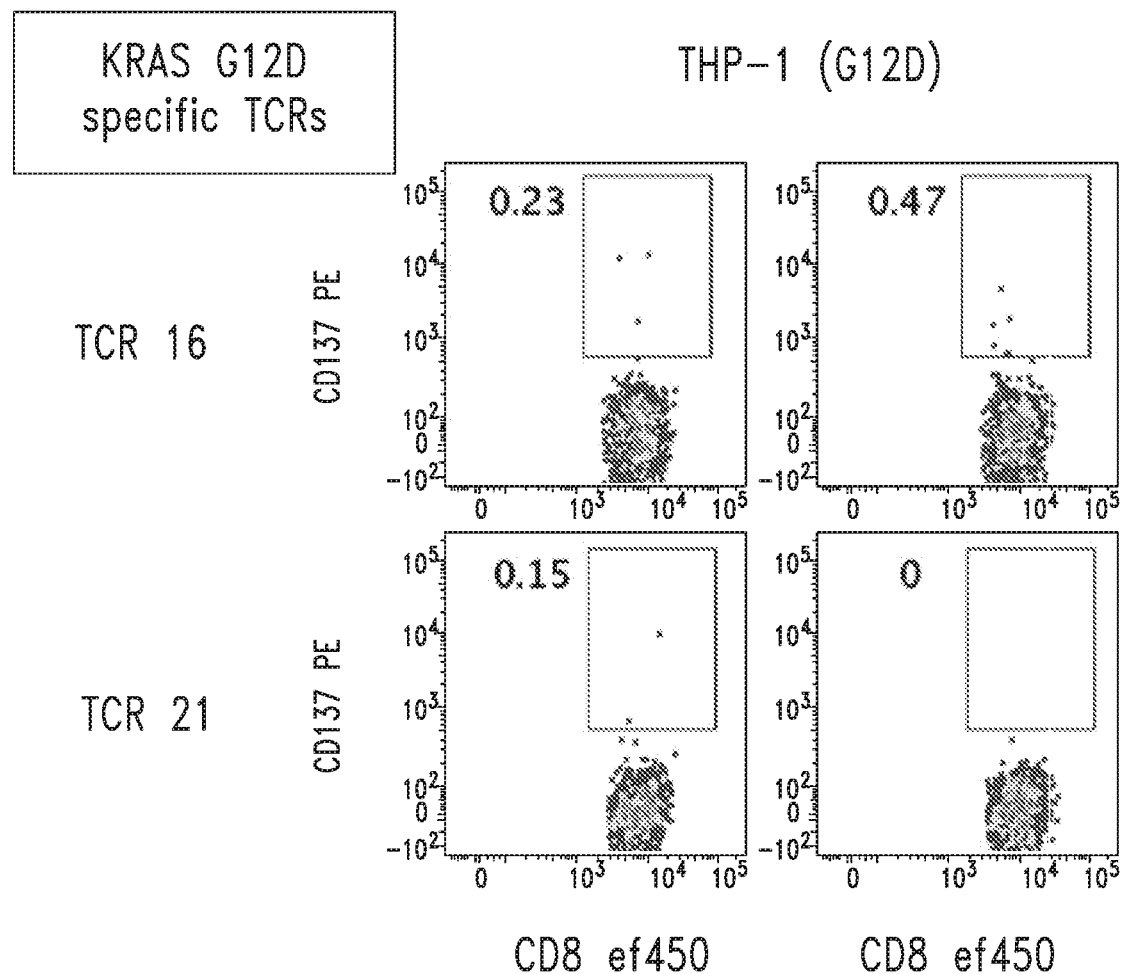
Figure 6F:
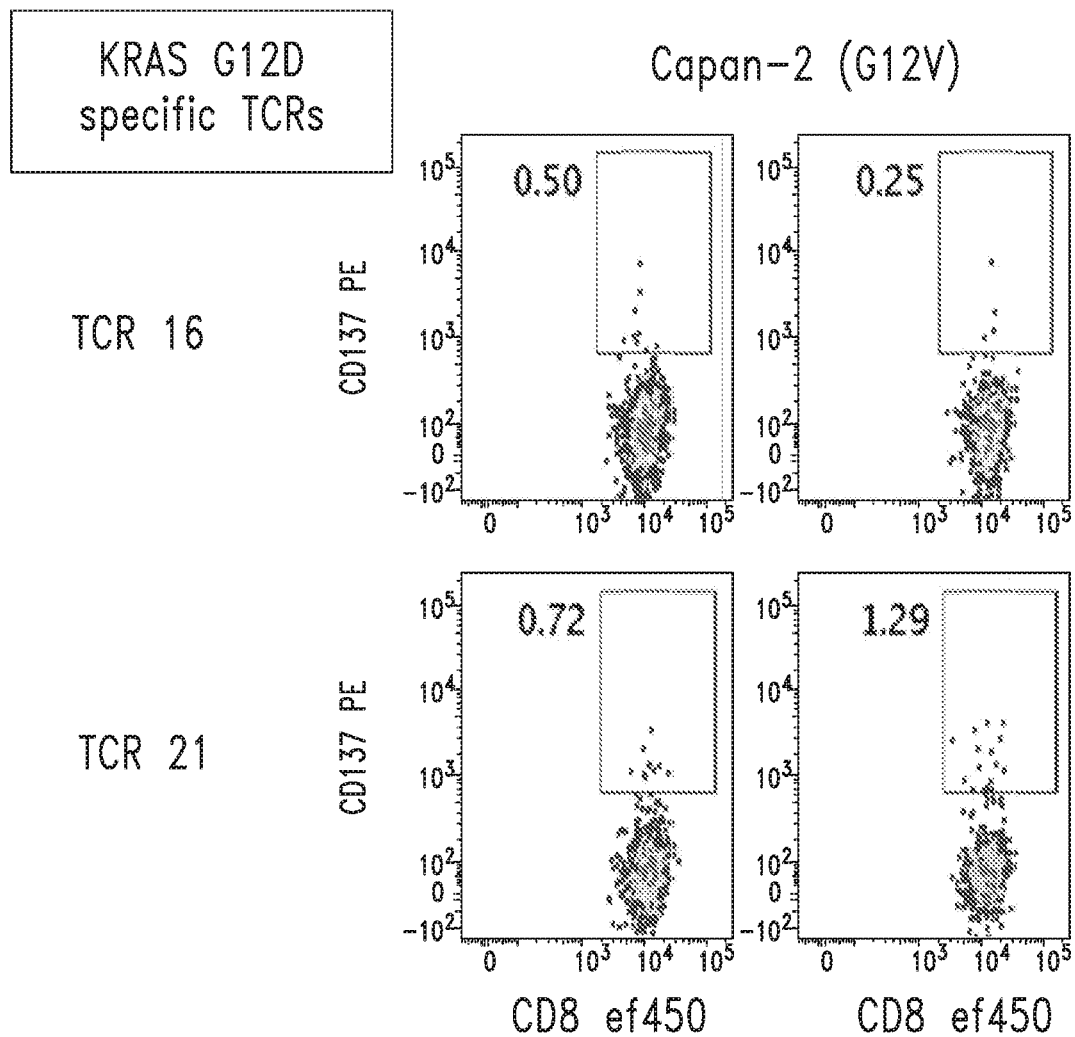
Figure 6G:
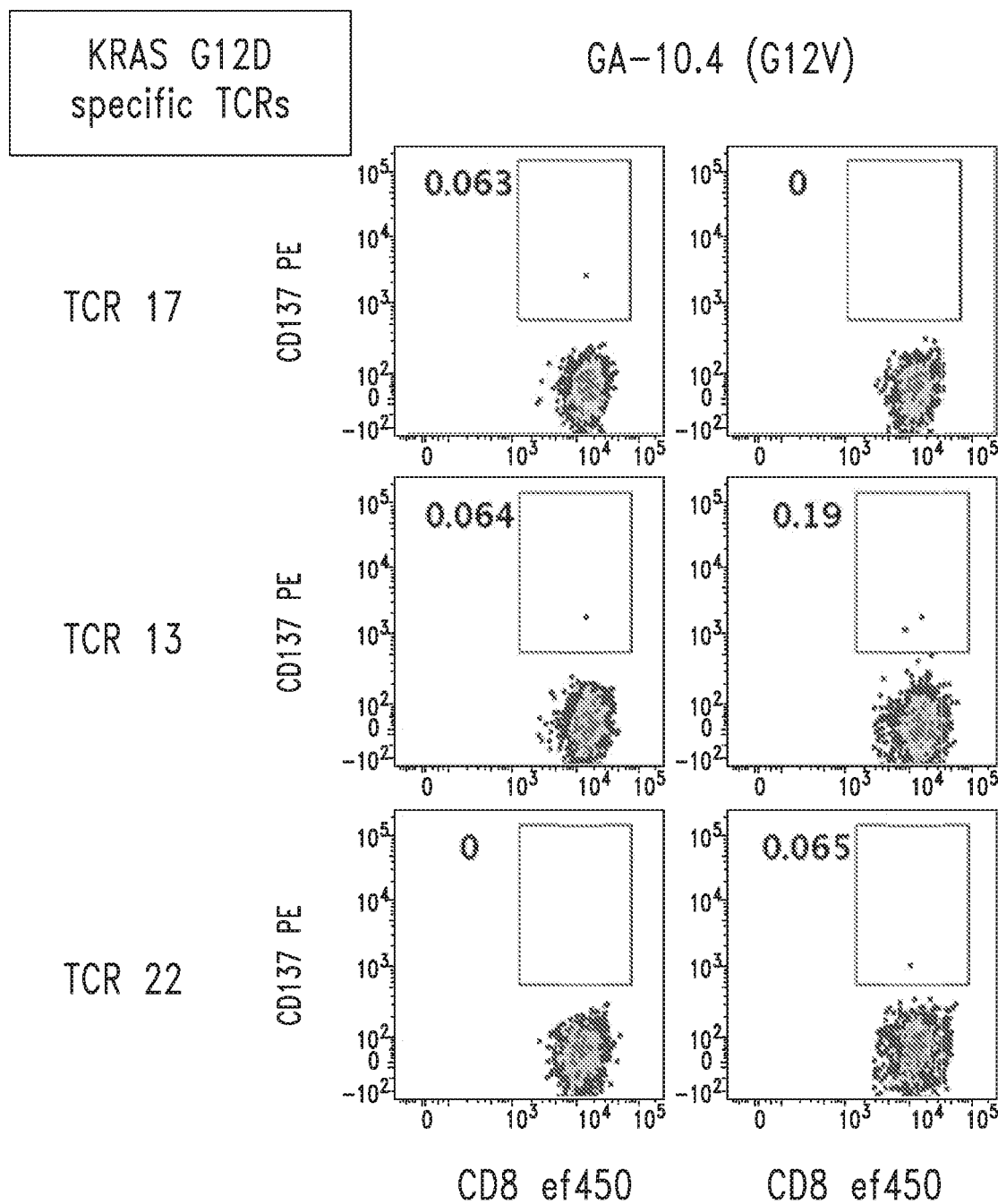
Figure 6G:
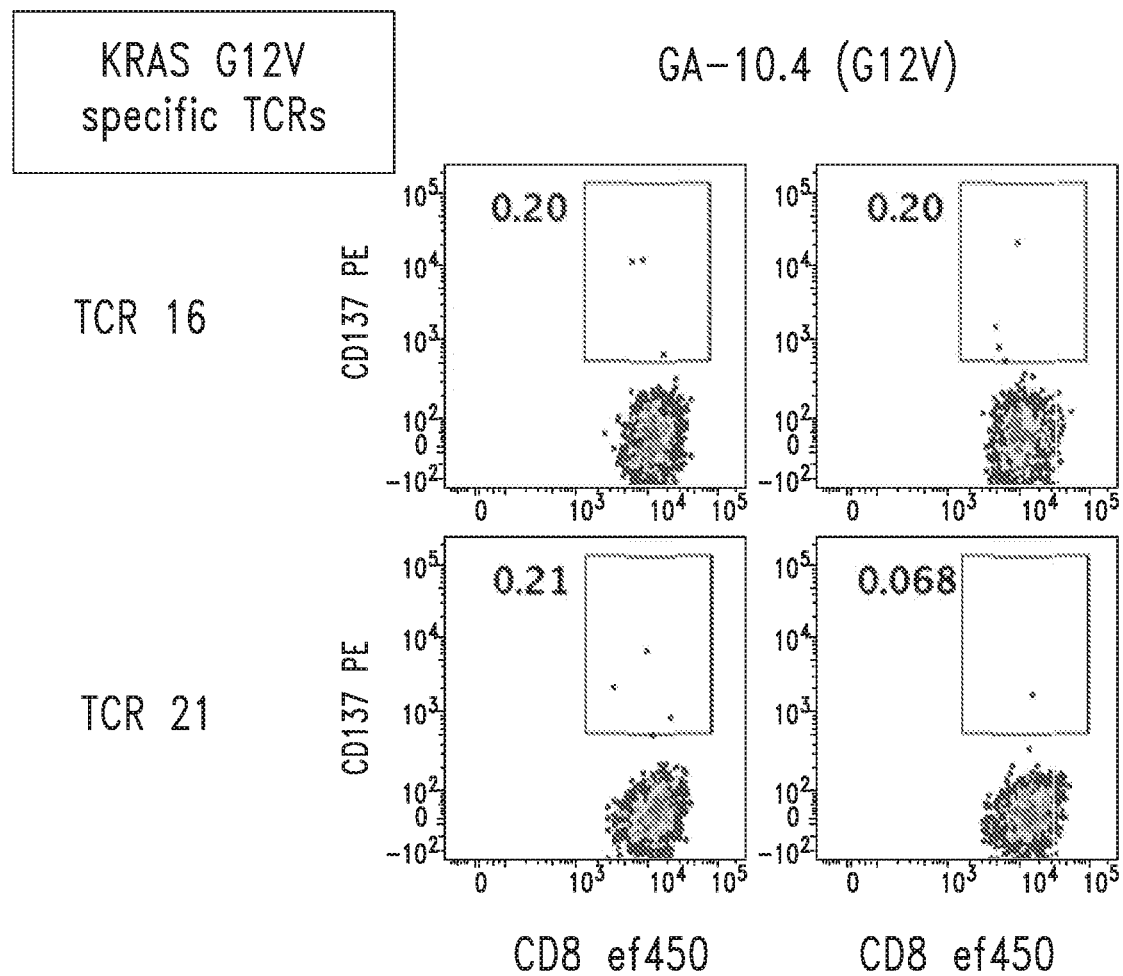
Figure 7A:
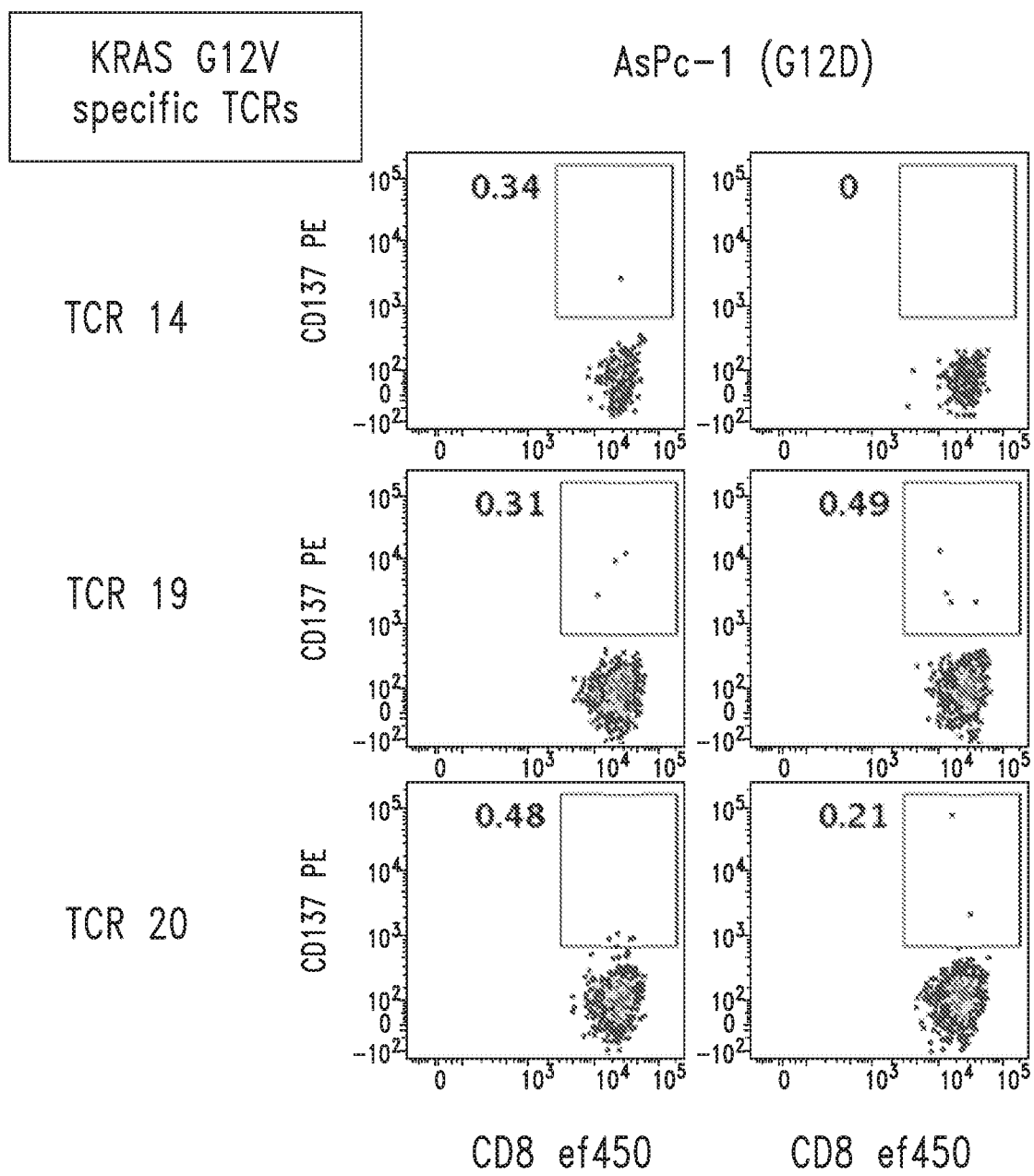
FIGS. 7A-7G show reactivity of exemplary HLA-A11 KRAS G12V mutation-specific TCRs respond to several cancer cell lines. TCRs were shown to be responsive to a KRAS G12V$^+$ pancreatic cancer cell line (Capan-2), as well as to a NRAS G12V$^+$ Burkitt's lymphoma cell line (GA-10.4).
Figure 7A:
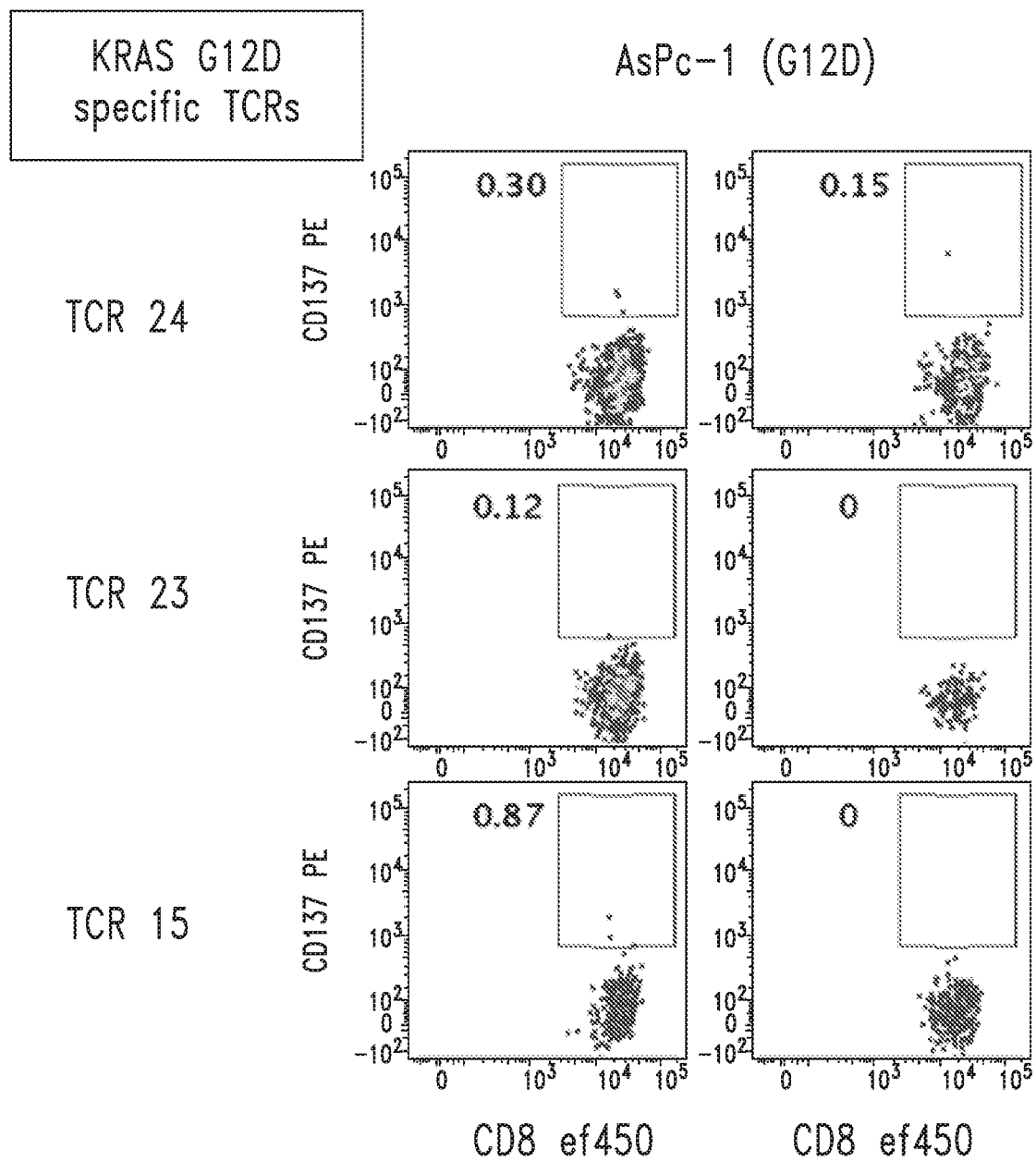
Figure 7B:
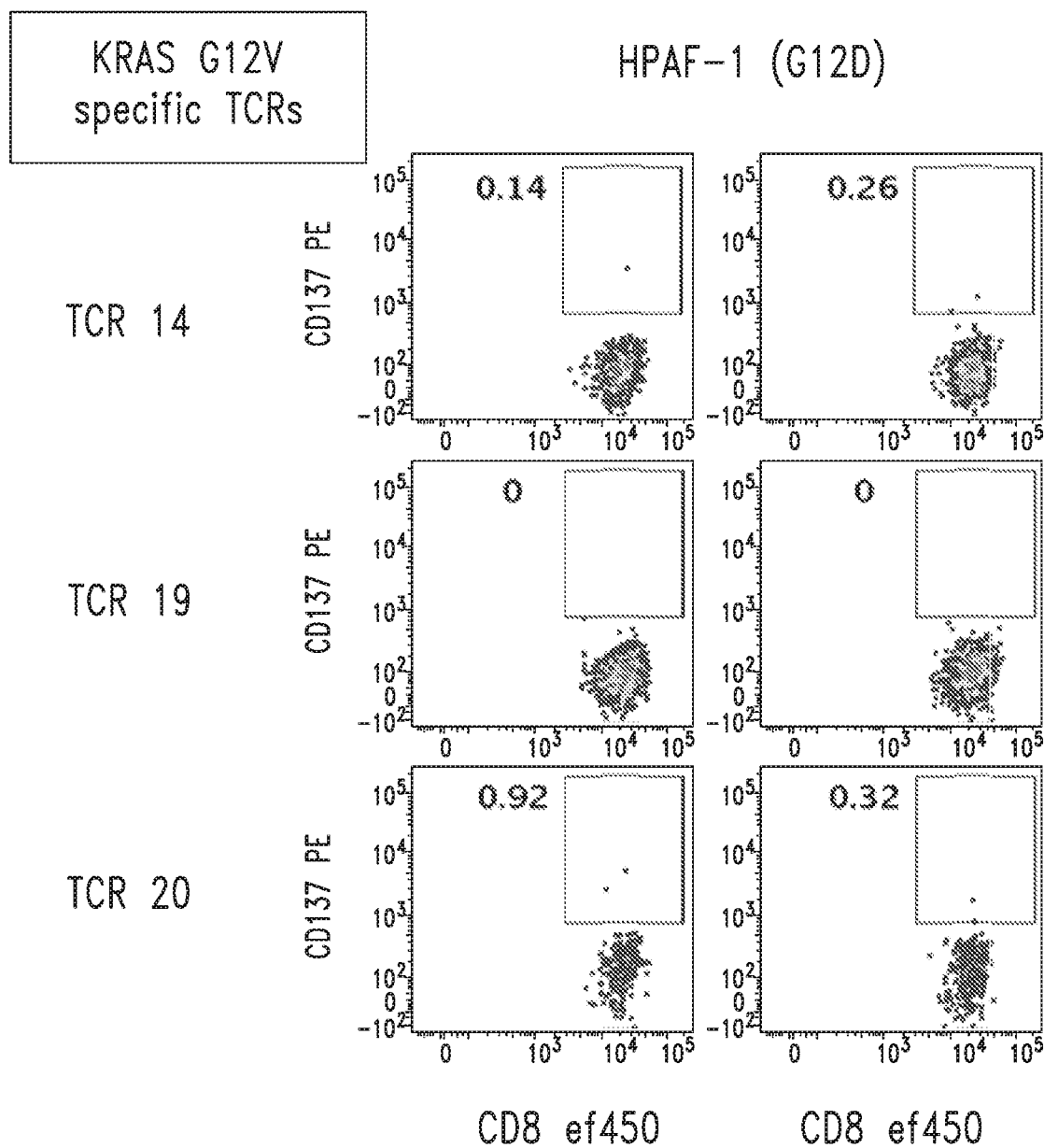
Figure 7B:
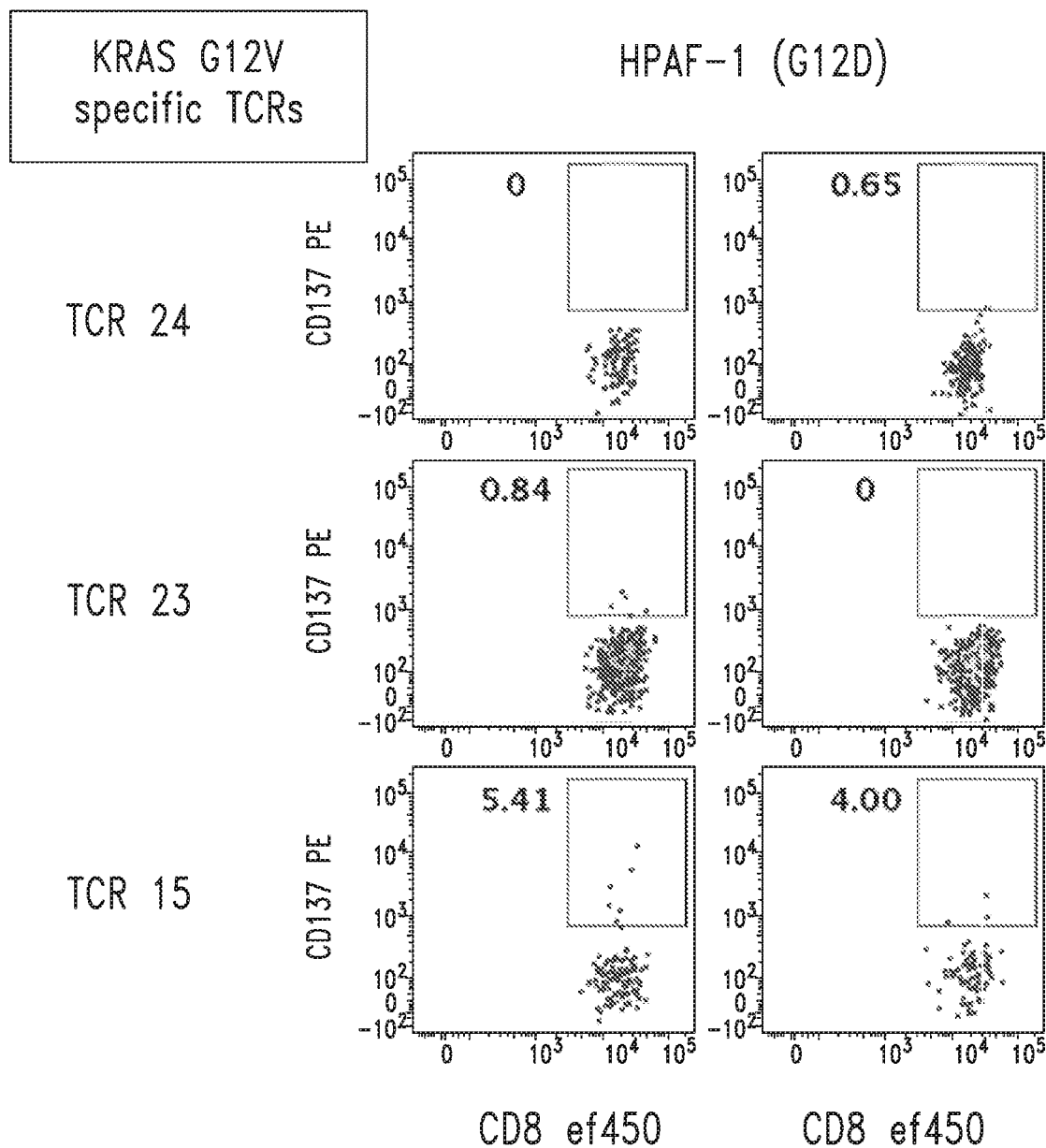
Figure 7C:
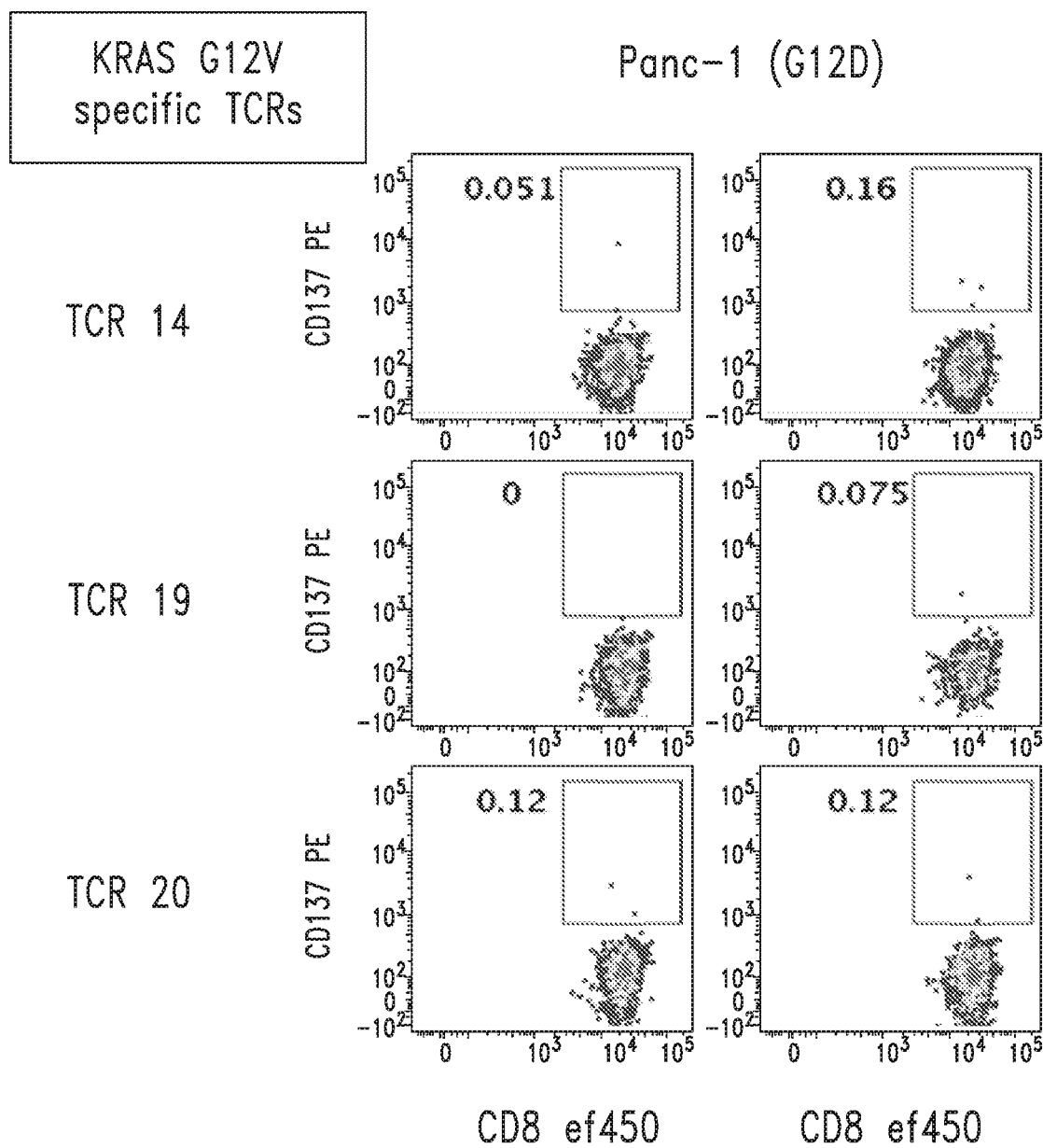
Figure 7C:
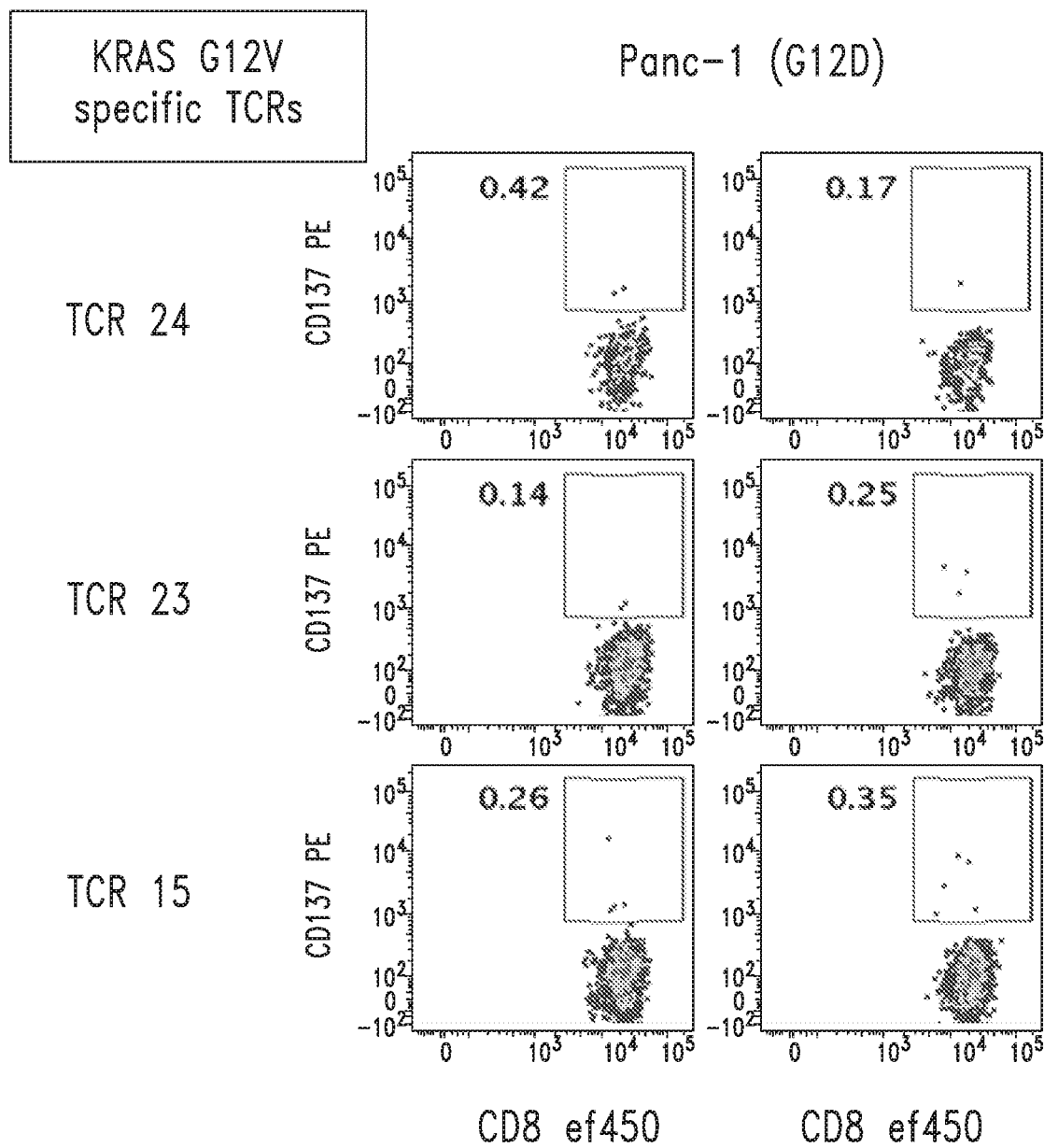
Figure 7D:
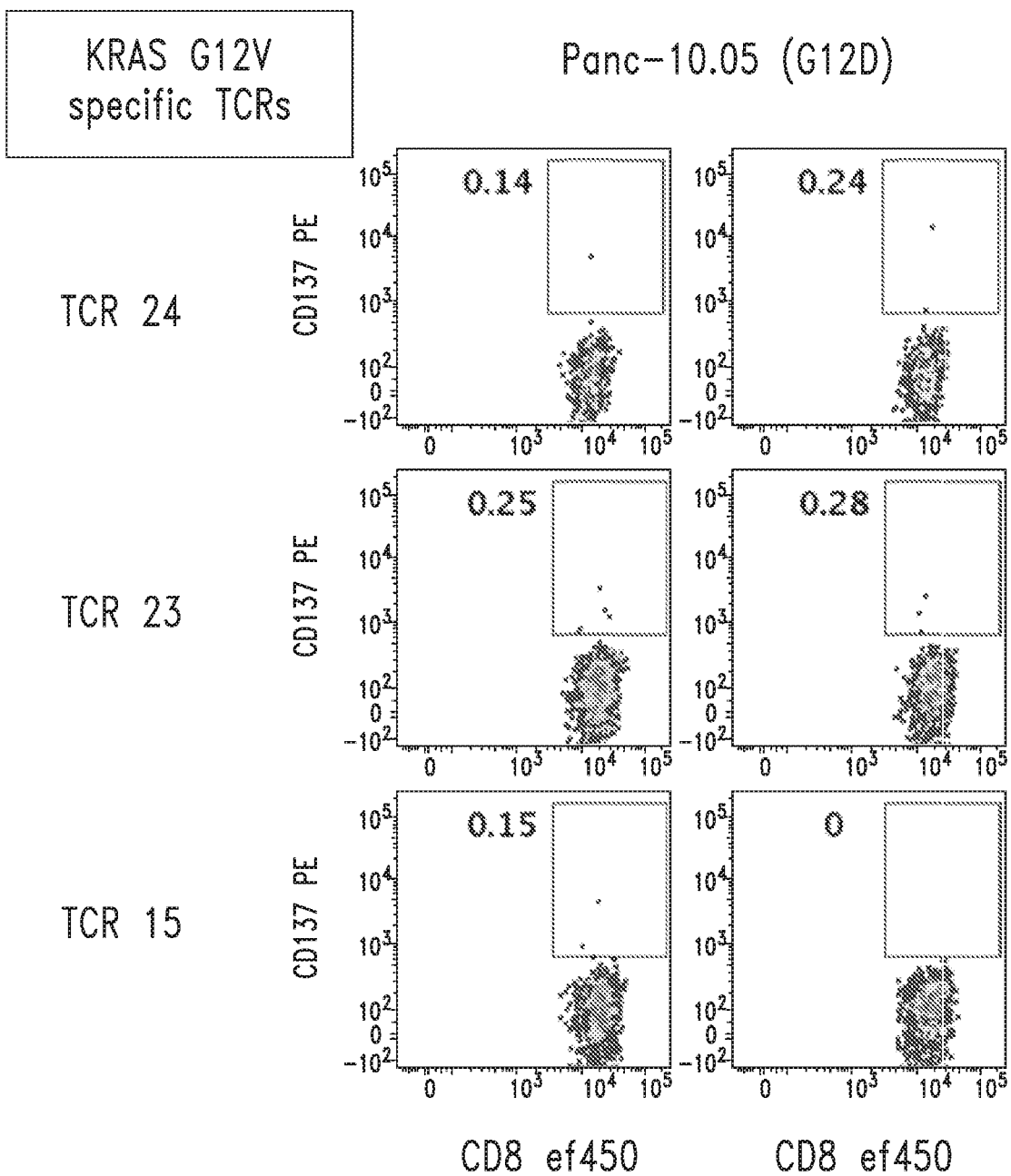
Figure 7E:
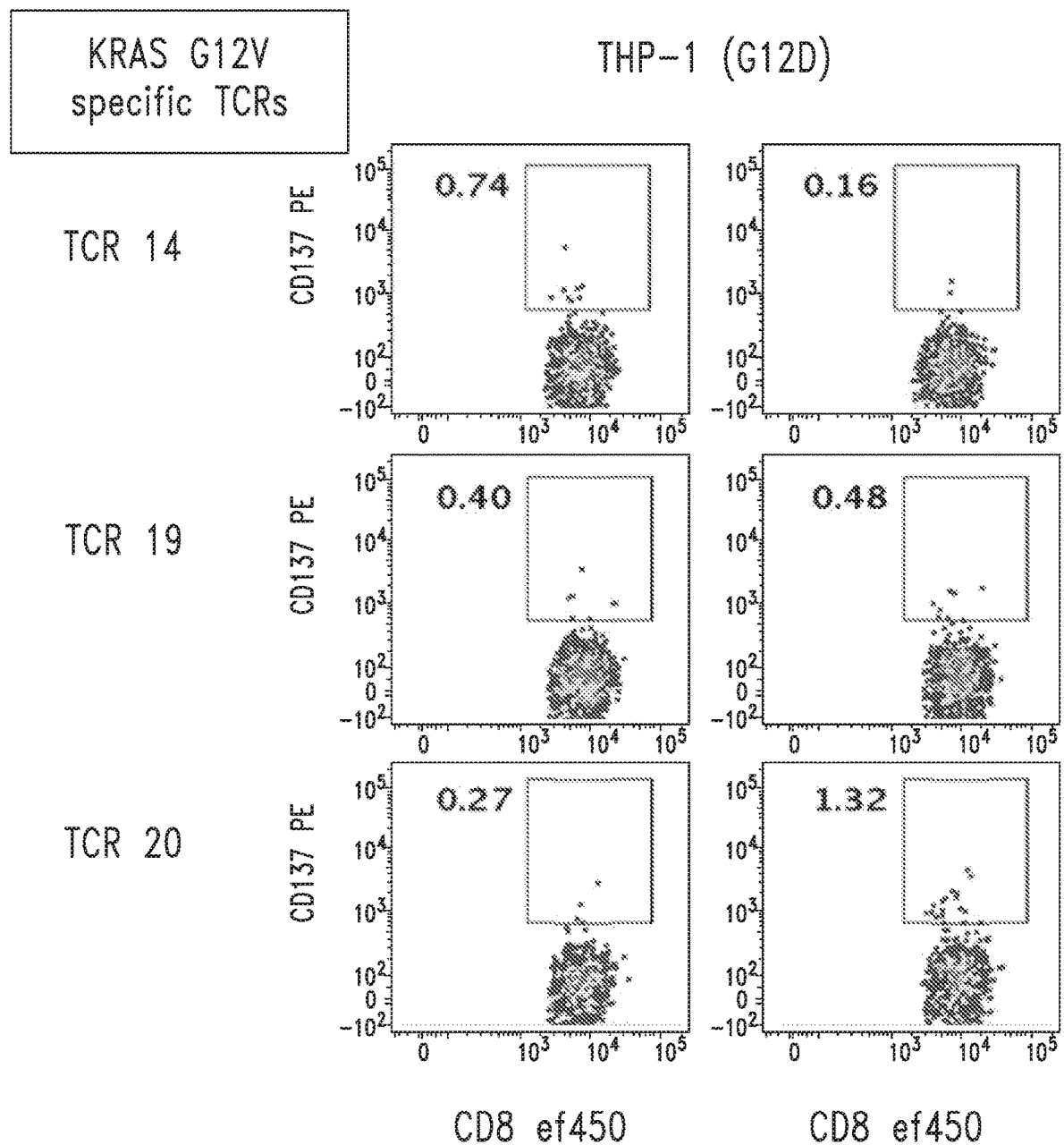
Figure 7E:
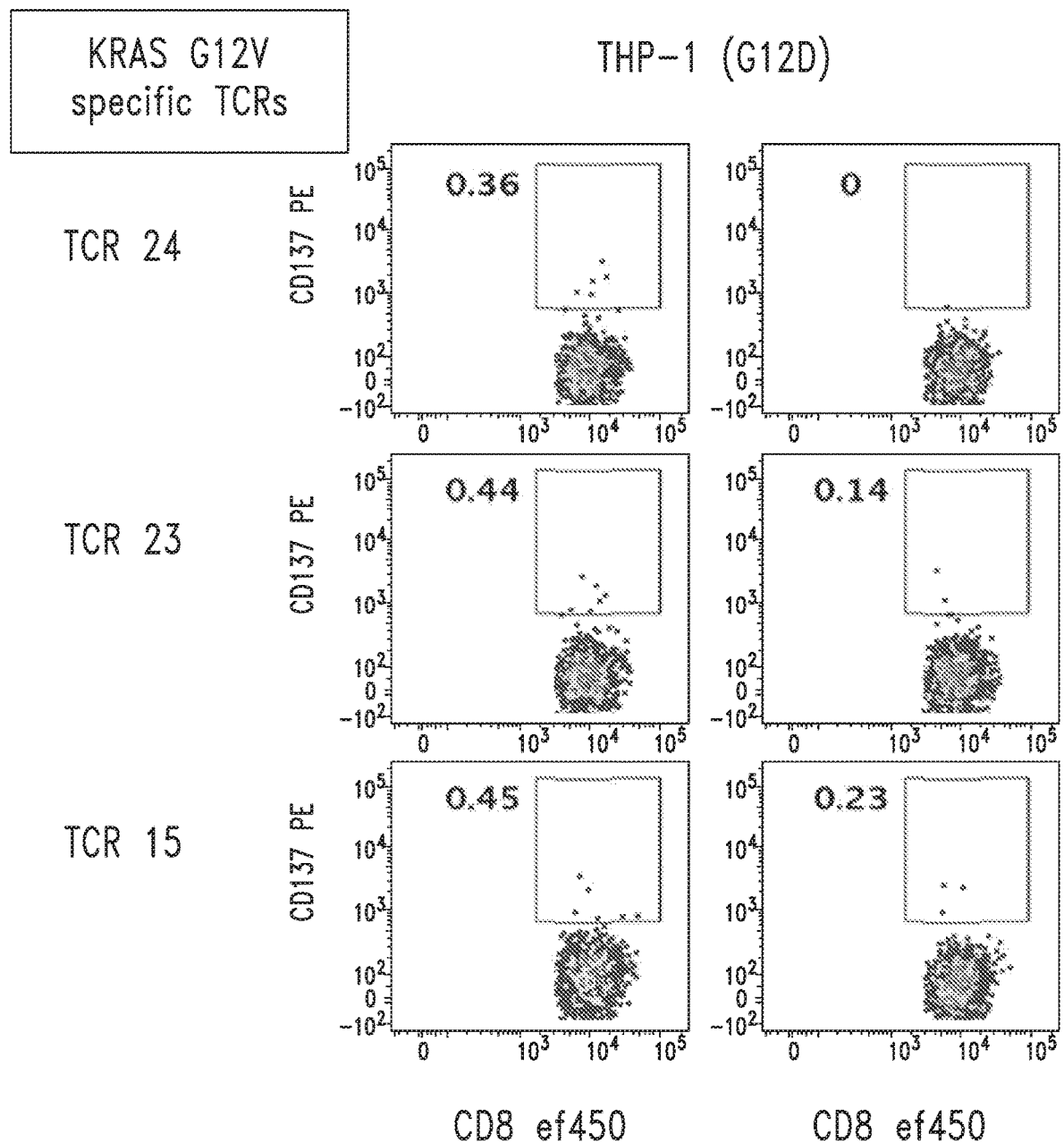
Figure 7F:
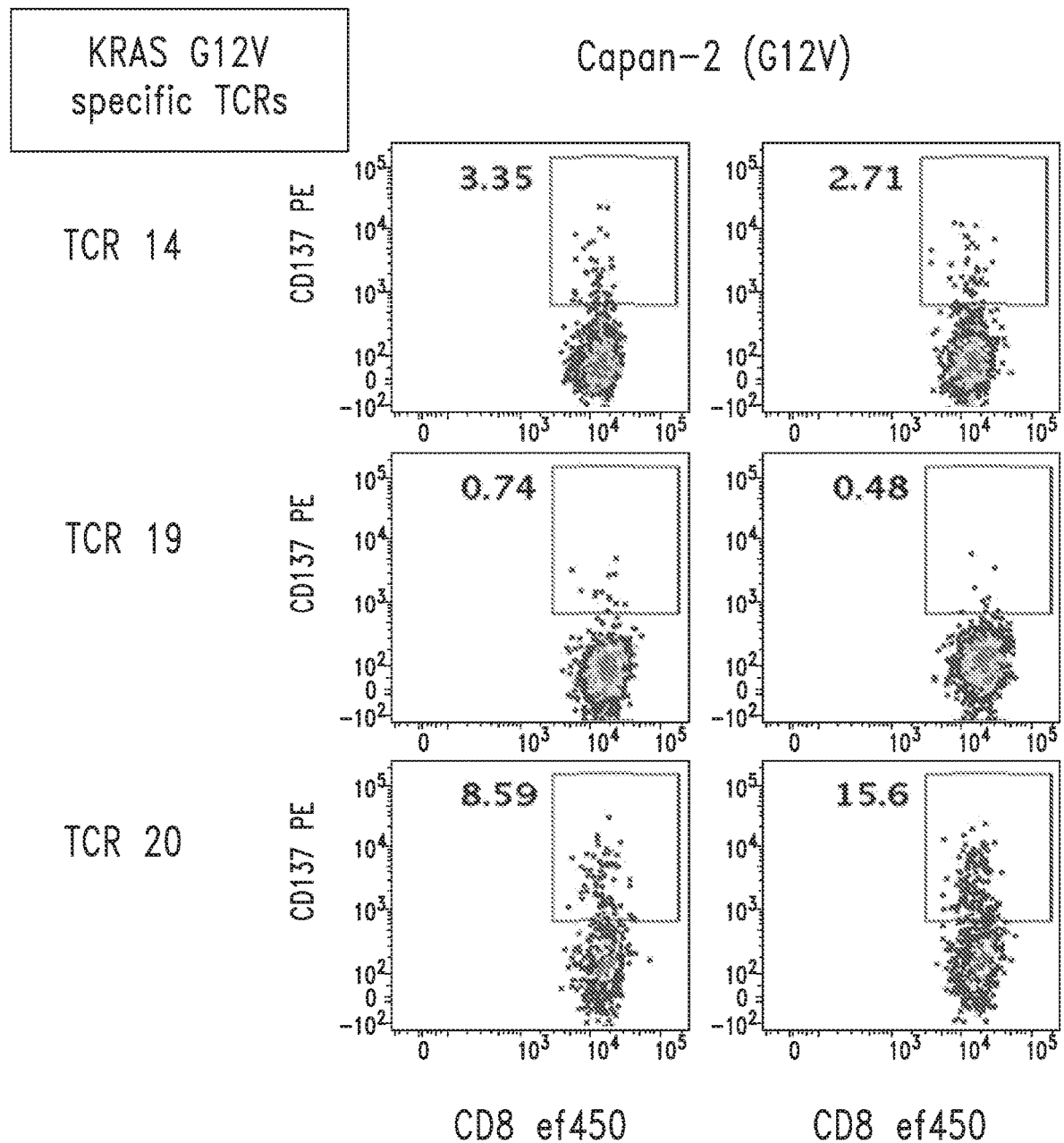
Figure 7F:
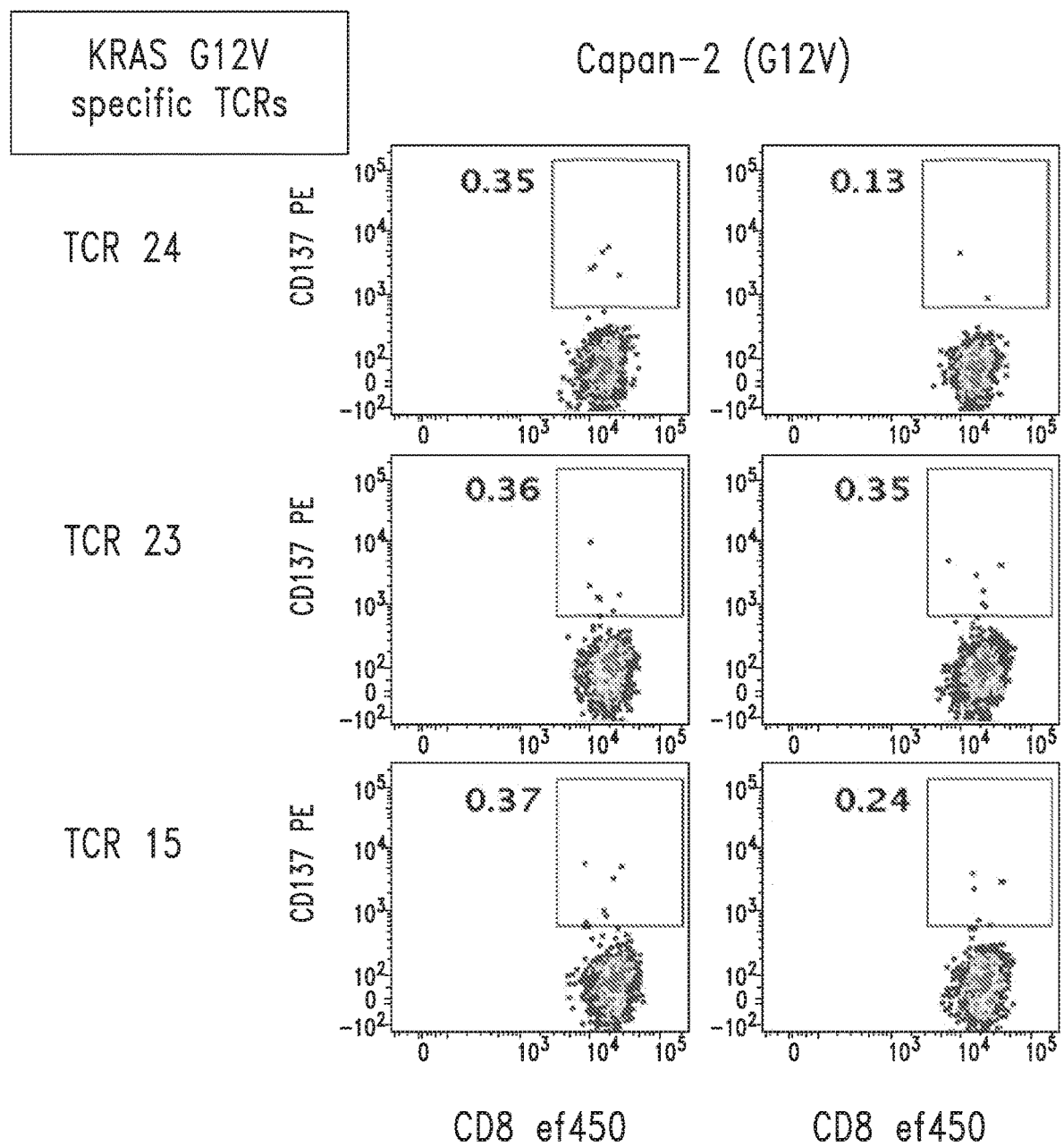
Figure 7G:
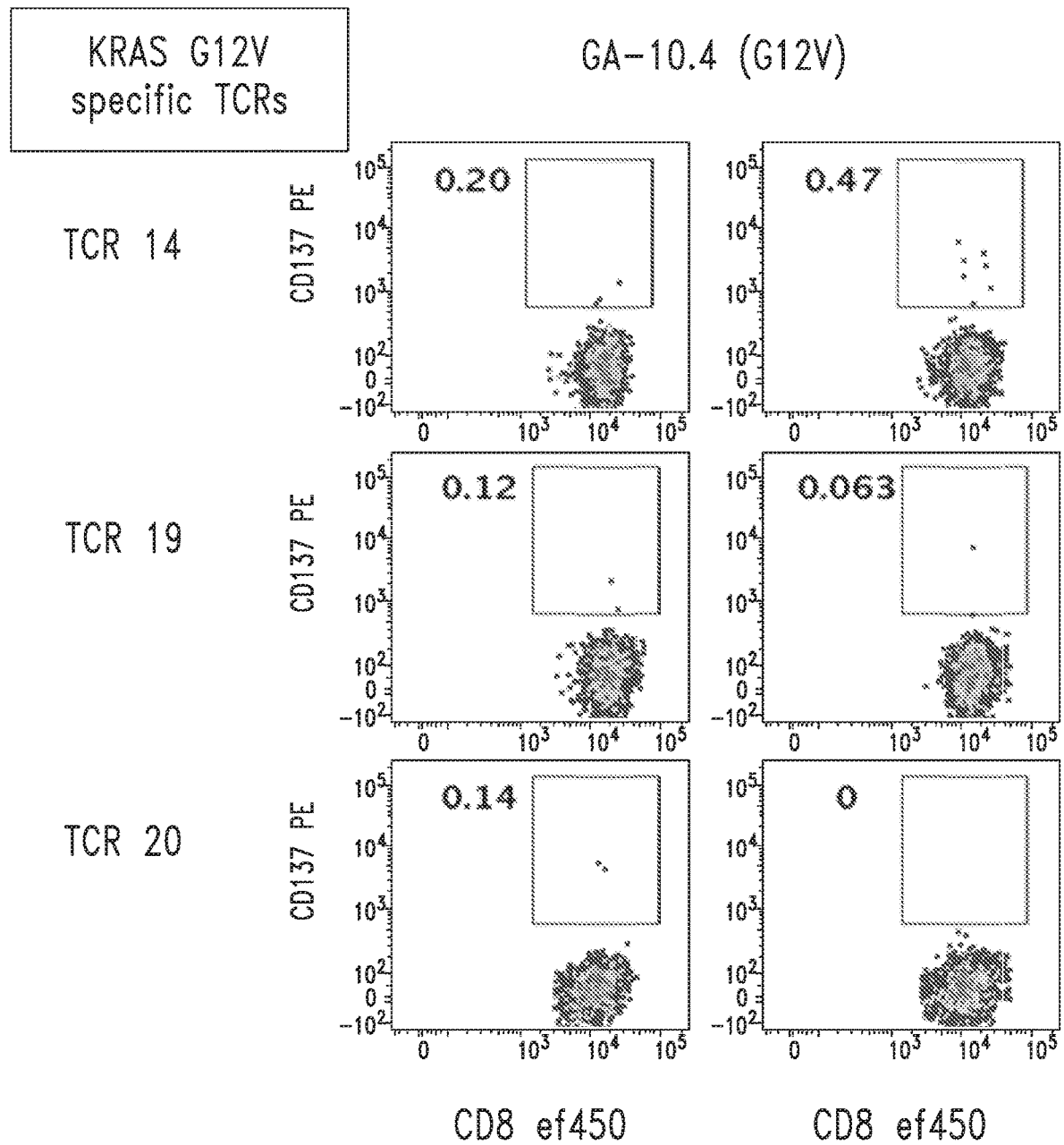
Figure 7G:
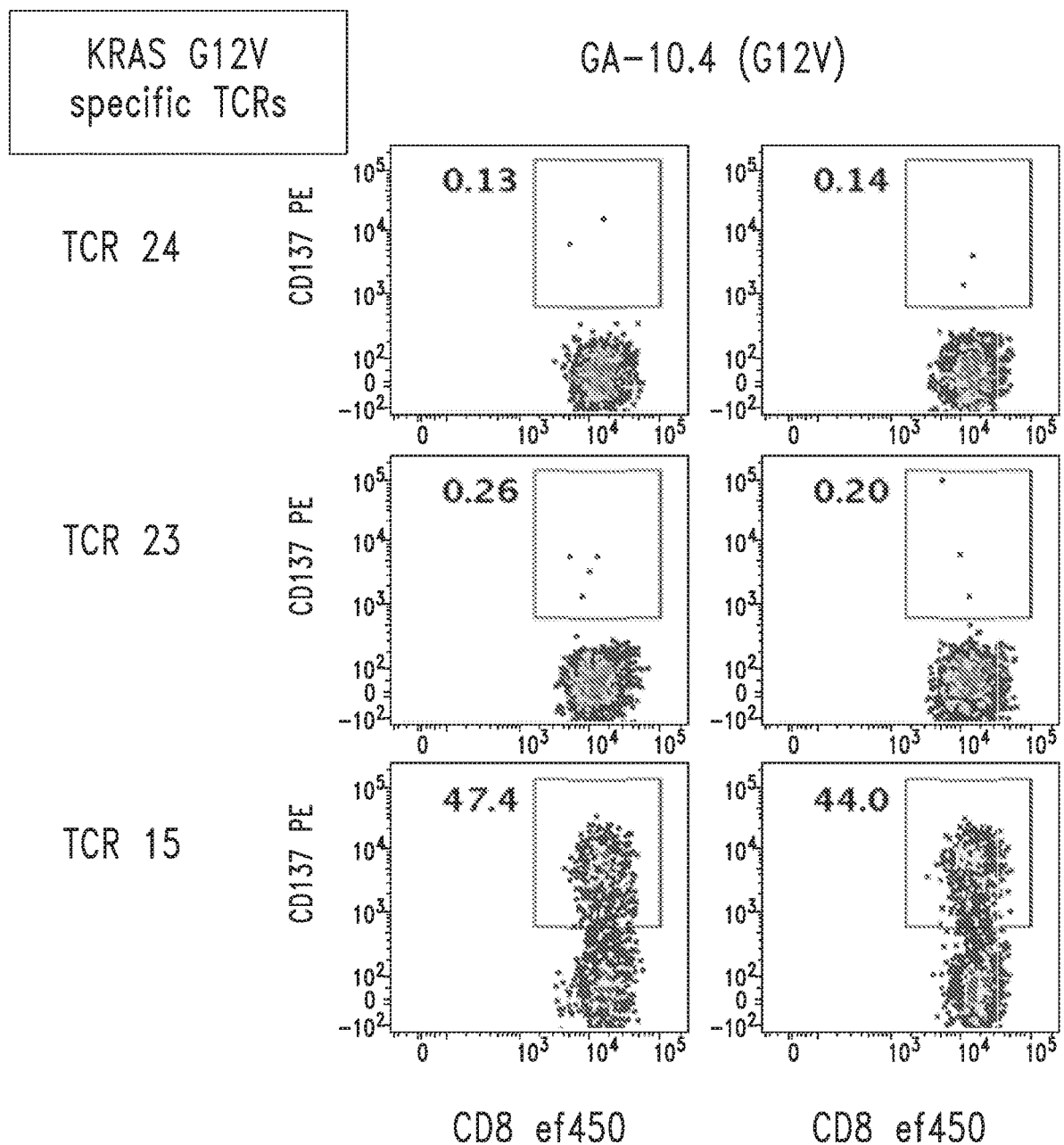

TCRs were then tested for function transduced host cells. Jurkat cells expressing Nur77-dtTomato reporter (reporting antigen-specific signaling in human T cells; see Ahsouri and Weiss, *J Immunol* 198(2):657-668 (2017)) were transduced with HLA-A11/KRAS-specific TCRs and incubated for 24 h with APCs loaded with mutated KRAS peptides. Data are shown in FIG. 3, and show that the transduced cells are functional in the presence of antigen-loaded APCs. Further, as shown in FIGS. 4A and 4B, T cells transduced with the exemplary TCRs recognize diverse mutant KRAS epitopes.

Data from additional characterization experiments is provided in FIGS. 5A-5D; these data show that primary CD8+ T cells expressing exemplary TCRs of the present disclosure produce IFN-γ following stimulation with antigen, and have high functional avidity.

TCR-transduced T cells were tested for reactivity in the presence of antigen-expressing tumor cell lines. Data are shown in FIGS. 6A-7G. Several TCR had elevated expression of CD137 when stimulated by THP-1, Capan-2, or GA-10.4 cells.

Figure 8A:
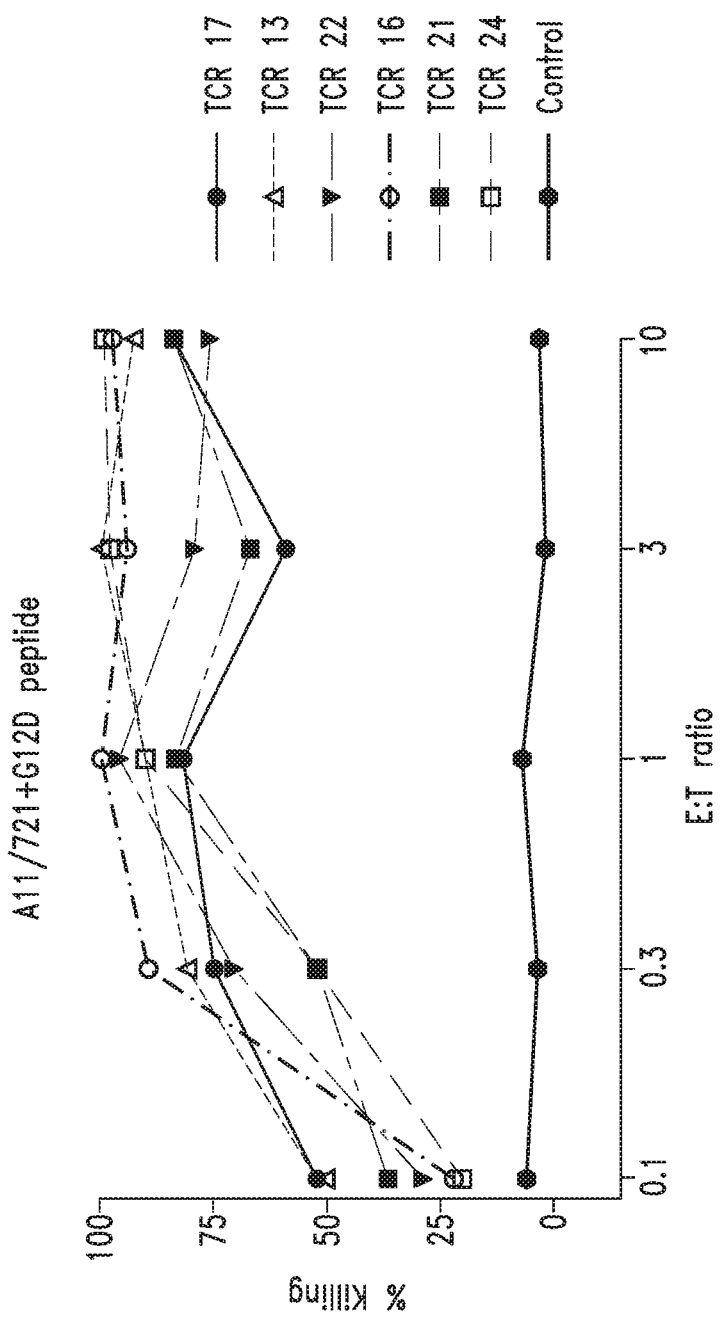
Figure 8B:
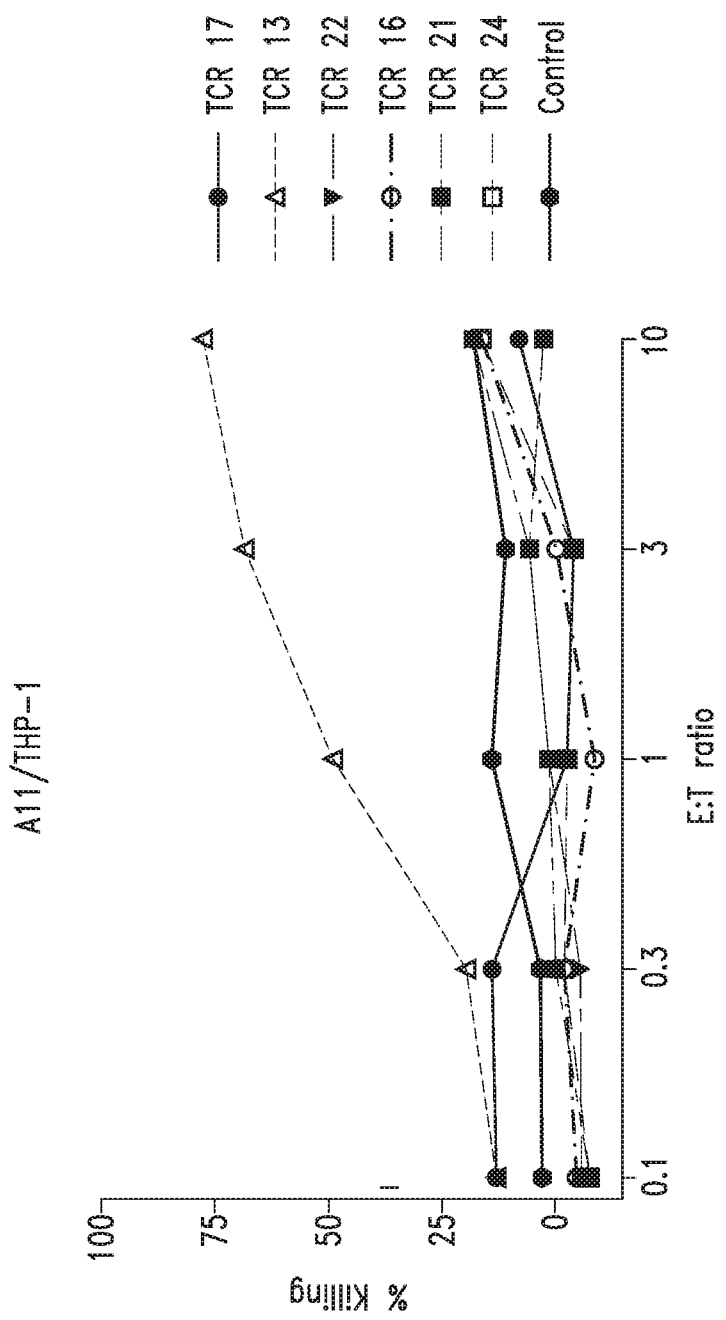
Figure 8C:
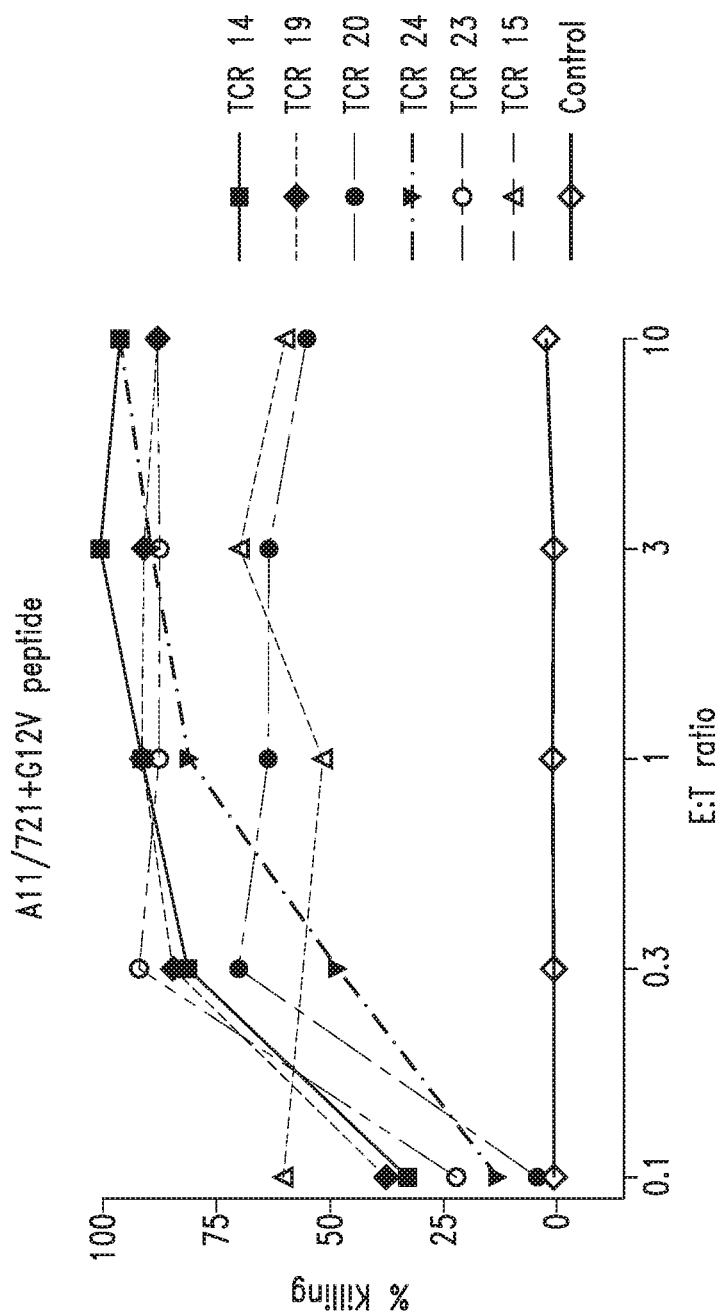
Figure 8D:
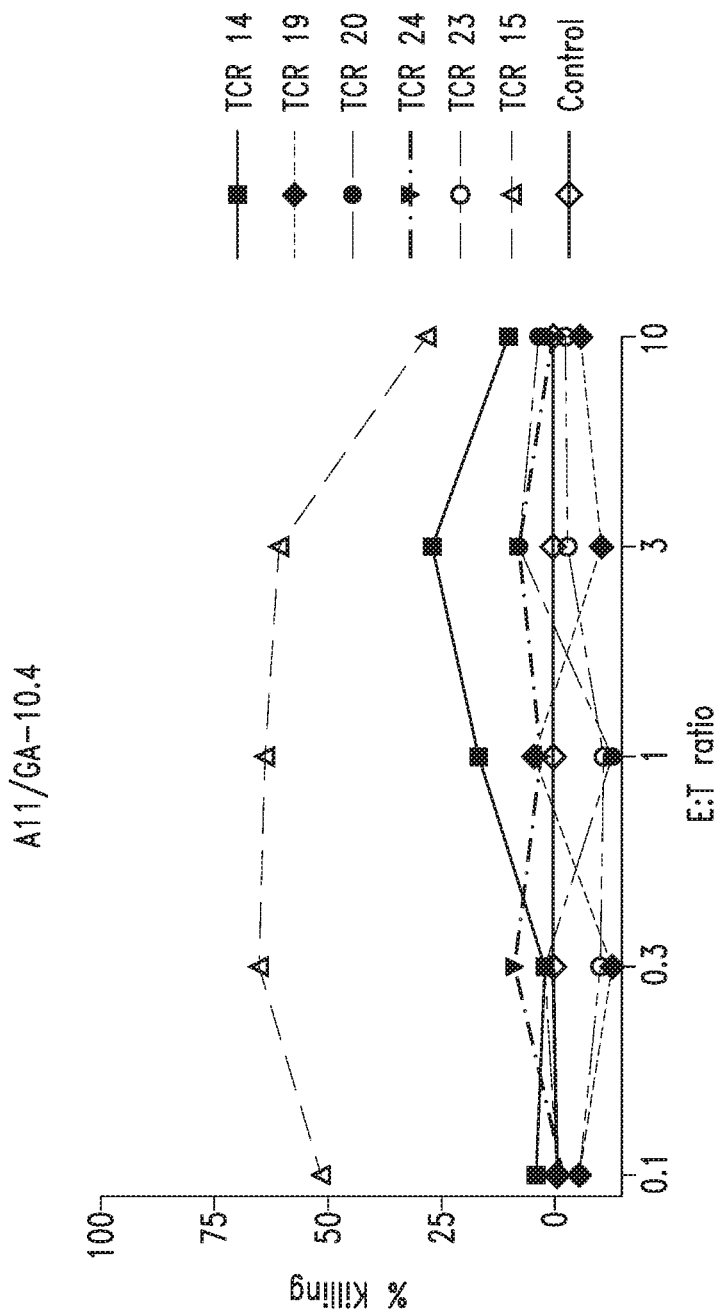

TCR-transduced T cells were tested for the ability to kill tumor cell lines (either exogenously expressing antigen or, in the case of 721 cells in FIG. 8A, coated with antigen) using an IncuCyte® killing assay. Data are shown in FIGS. 8A-8D. Additional killing assays were performed using tumor cell lines. As shown in FIGS. 21A-22B, TCR-transduced T cells effectively killed Panc-1, AsPc-1, CFPAC-1, and/or Capan-2 cells.

Example 2

Generation and Characterization of TCRs Specific for Mutant KRAS:HLA-A*03:01

Figure 10:
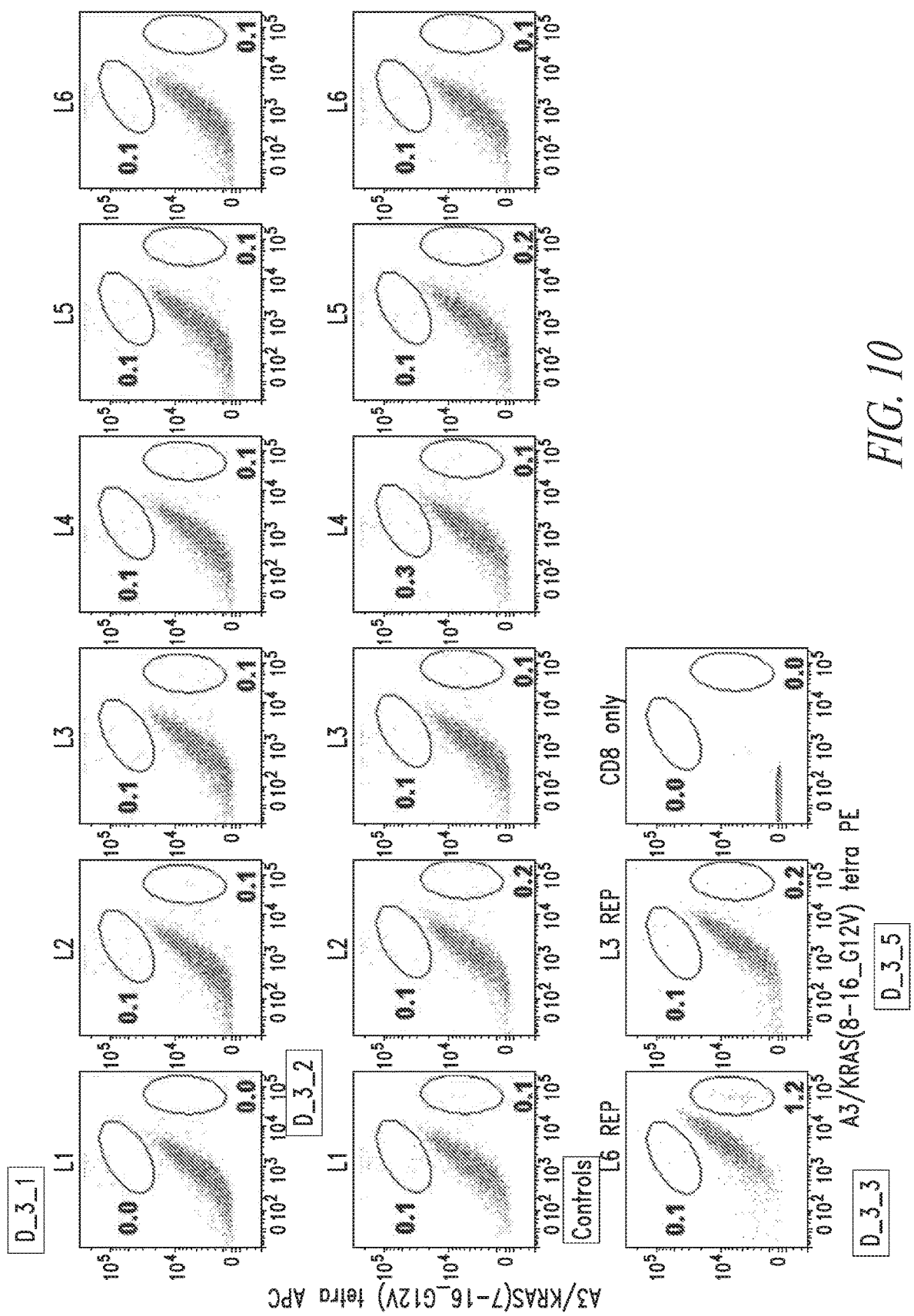
Figure 10:
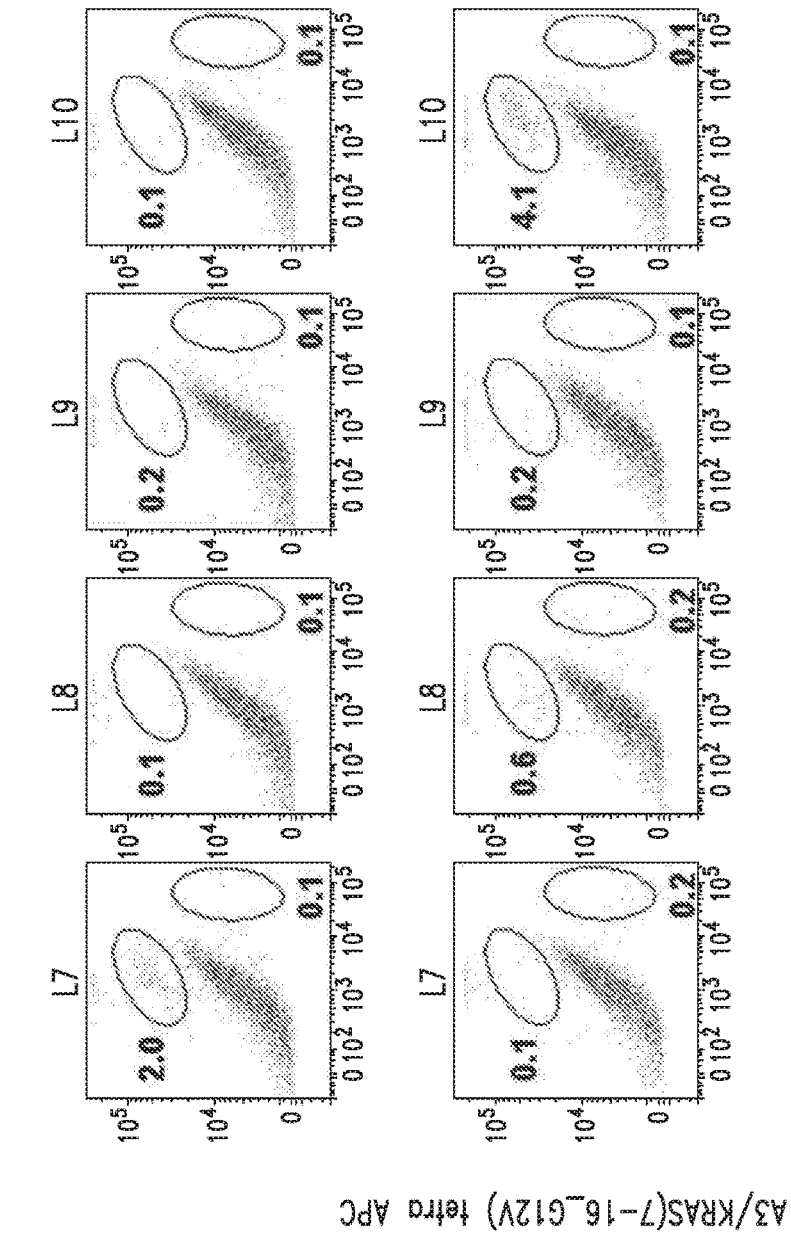
Figure 11:
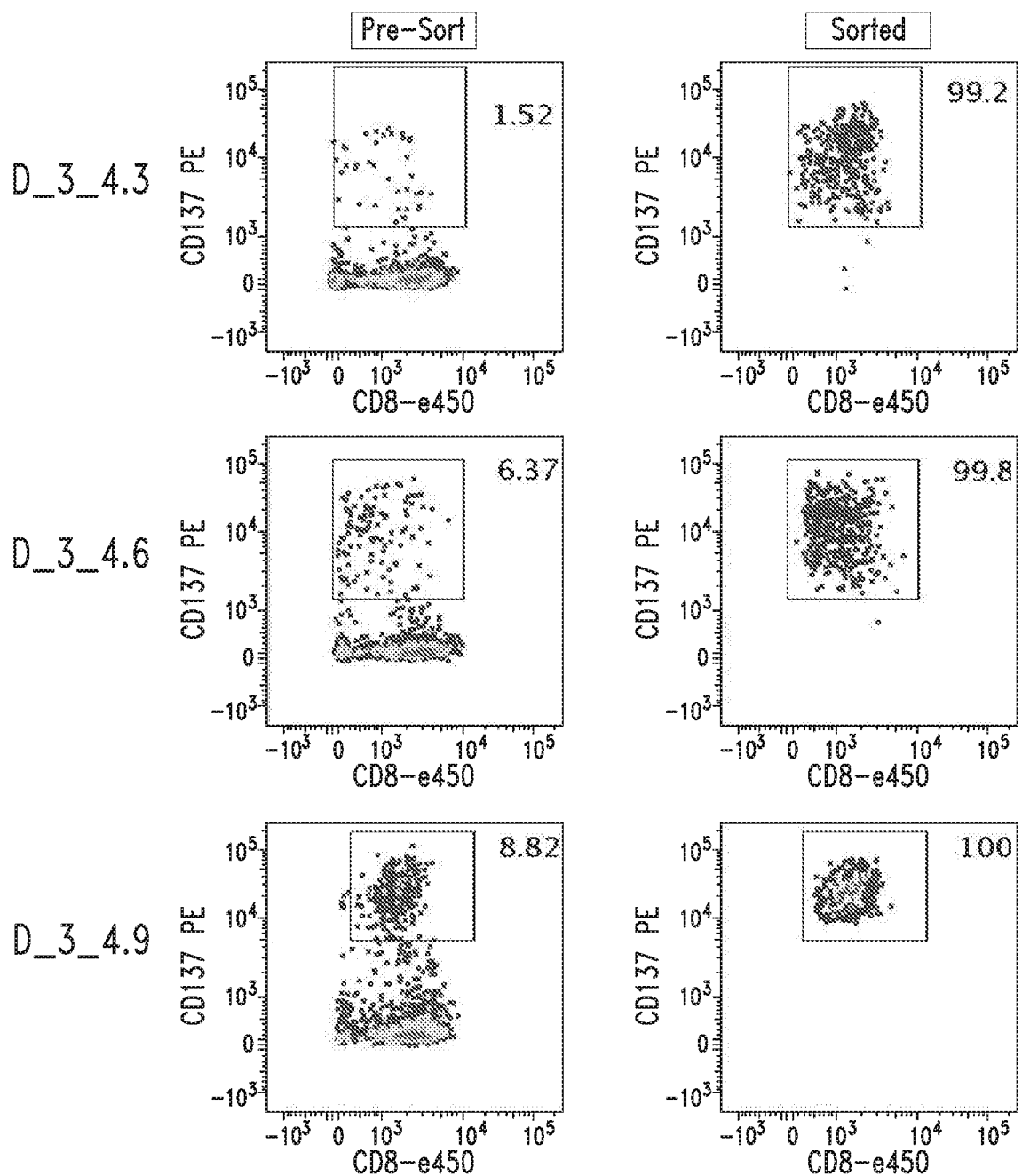

Predicted HLA-binding affinity of mutated KRAS G12V peptides (10-mer (VVVGAVGVGK; SEQ ID NO:2); 9-mer (VVGAVGVK; SEQ ID NO:3)) for HLA-A*0301 was measured using NetMHC version 3.4 (available online at cbs.dtu.dk/services/NetMHC/). Results are shown in FIG. 9. HLA-A3/KRAS (G12V)-specific T cell lines from healthy donors were detected by tetramer labelling following 3 rounds of peptide stimulation (FIG. 10). Next, T cell lines were stimulated with peptide and scored on CD137 or tetramer.

Example 3

Generation and Characterization of TCRs Specific for Mutant KRAS:HLA-A*02:01

Figure 13A:
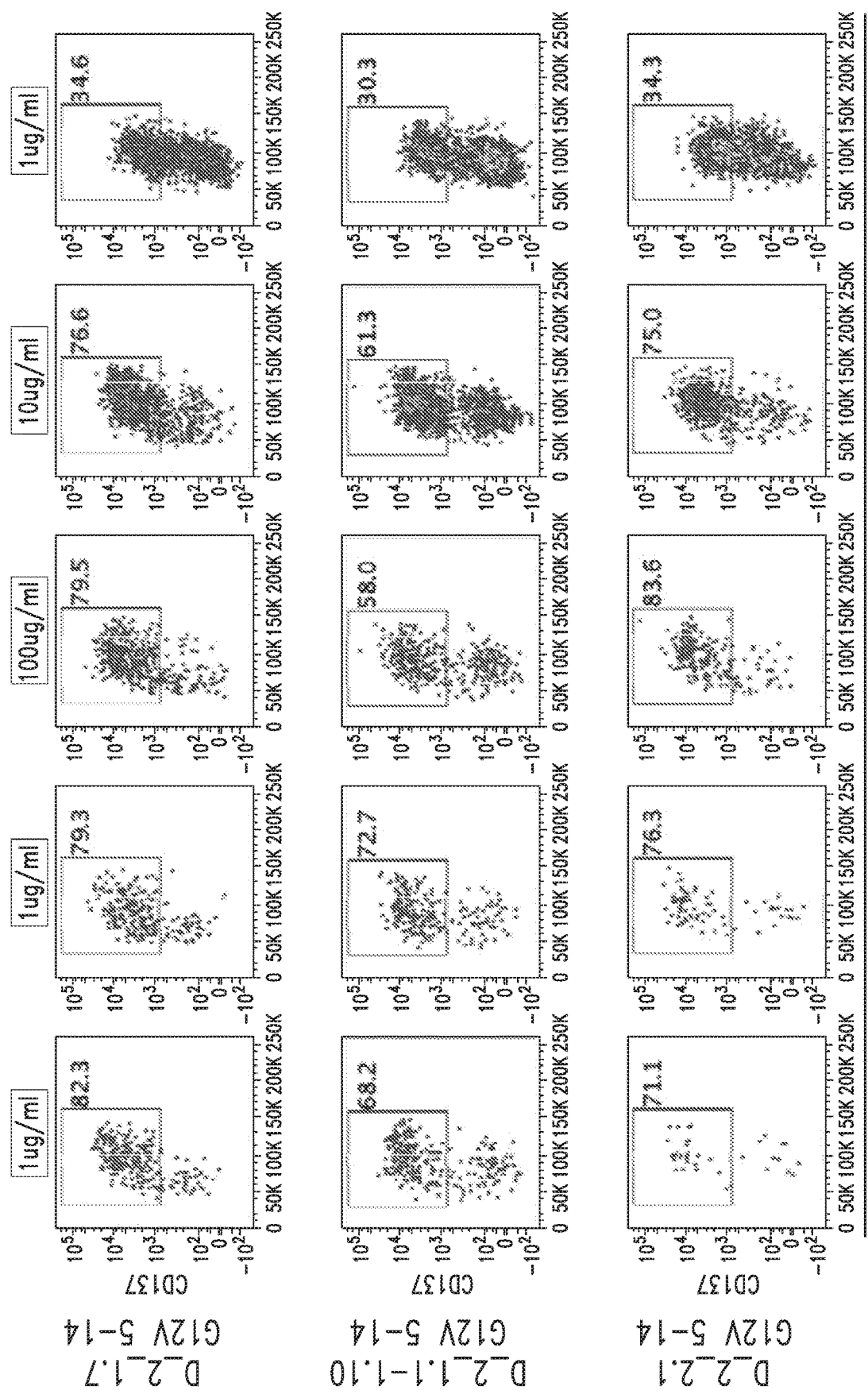
FIGS. 13A and 13B show that sorted exemplary HLA-A2/KRAS-specific T cells of the present disclosure upregulate CD137 in response to peptide stimulation.
Figure 13A:
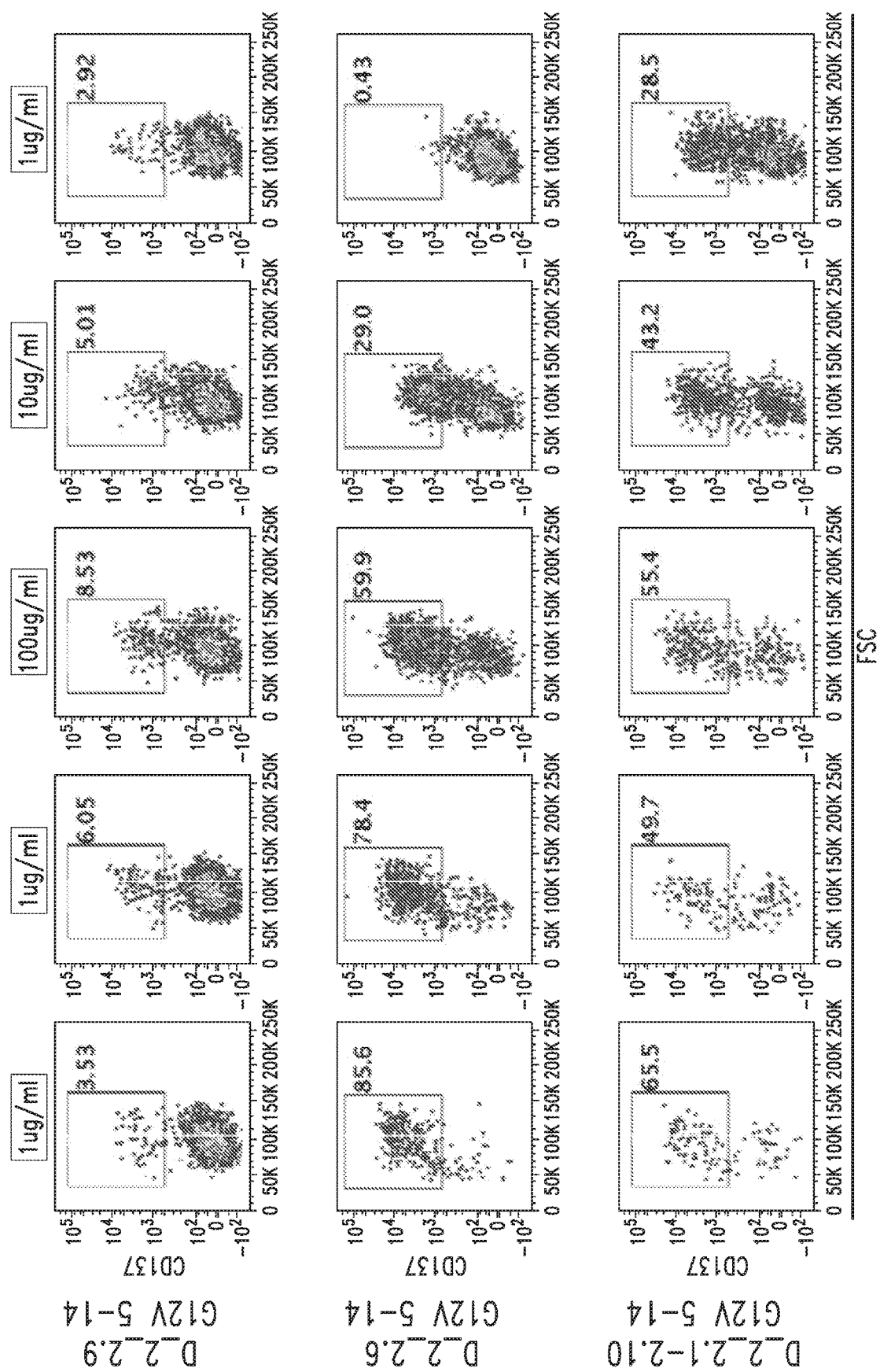
Figure 13B:
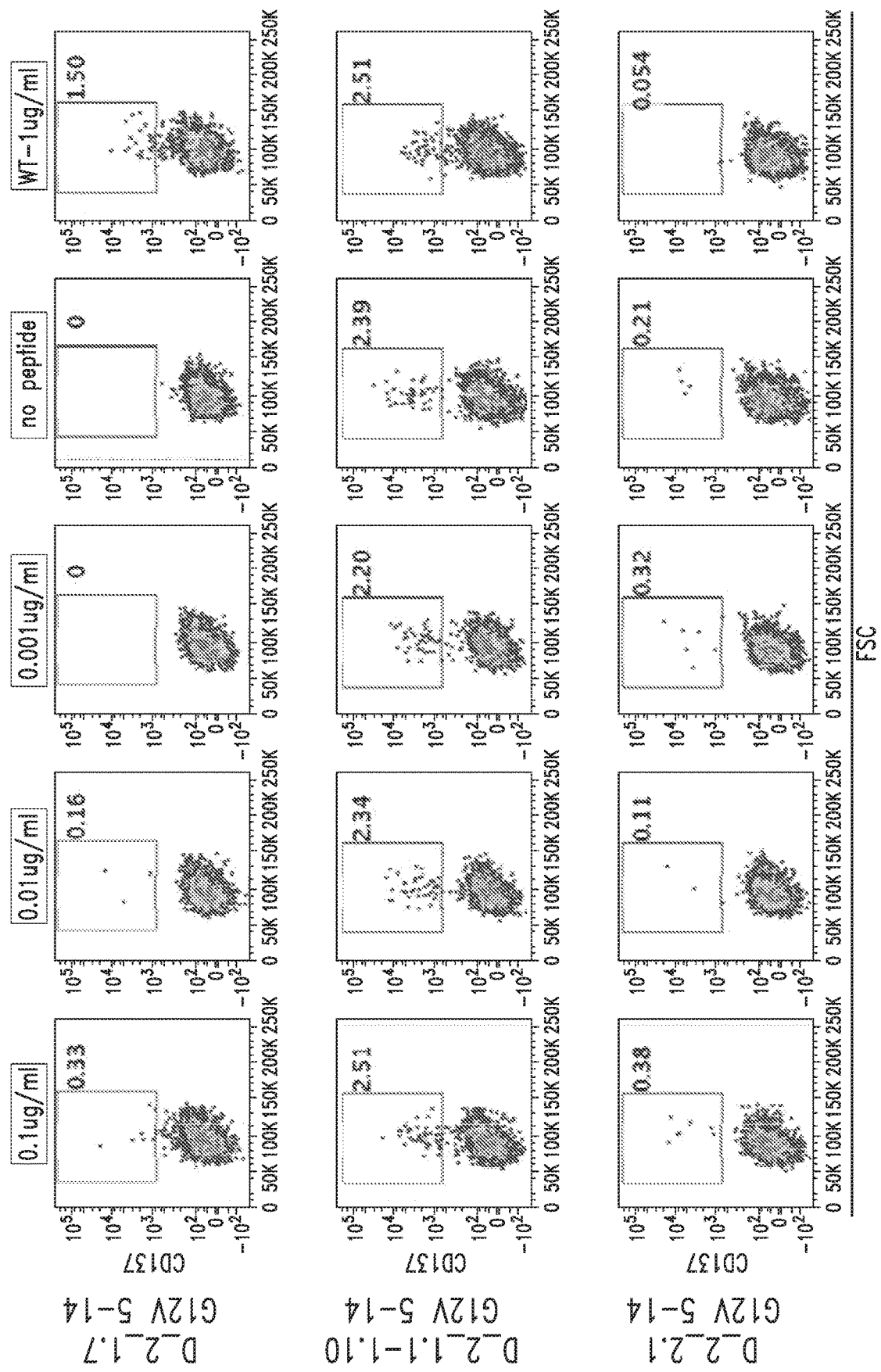
Figure 13B:
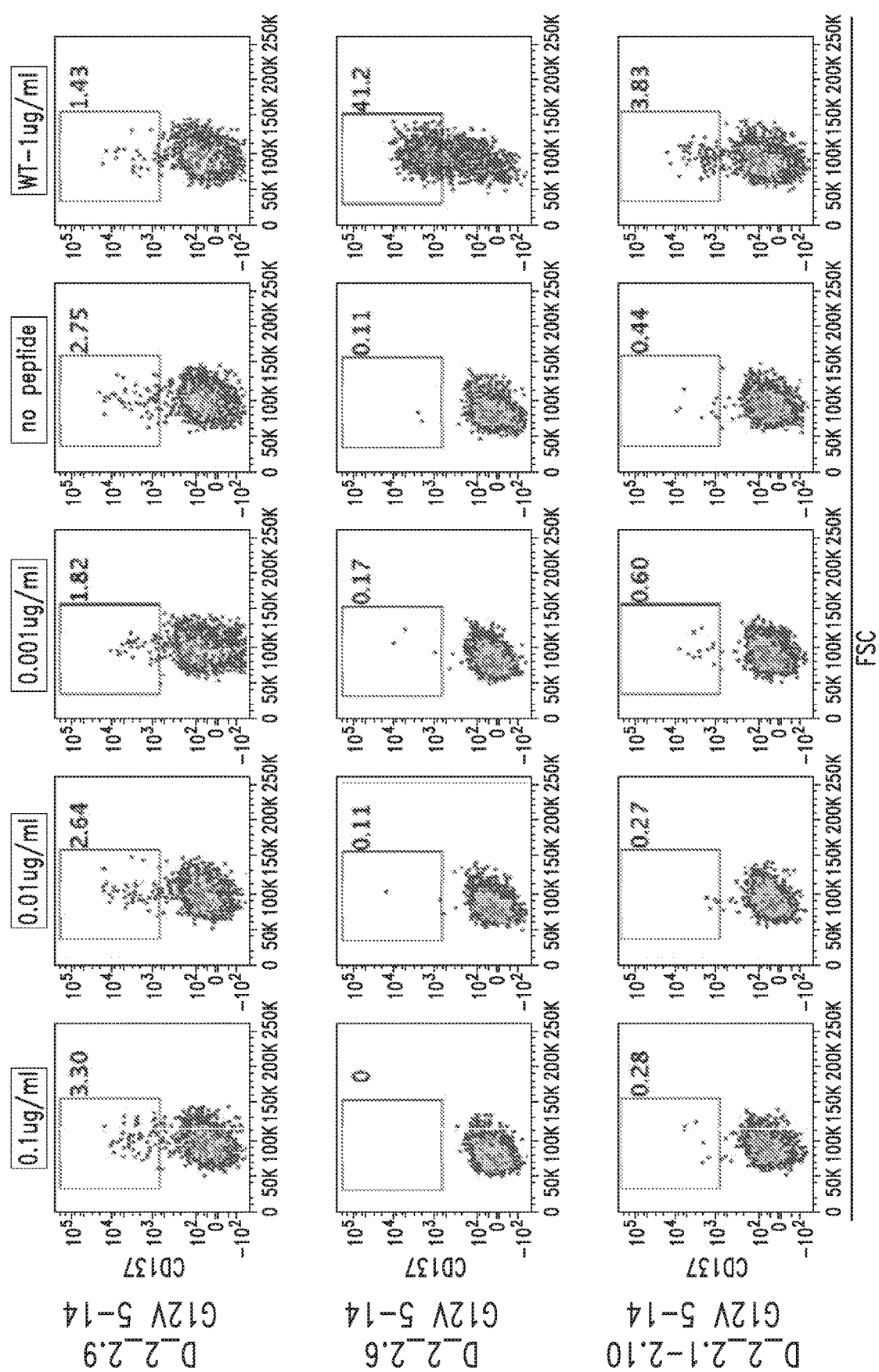
Figure 15A:
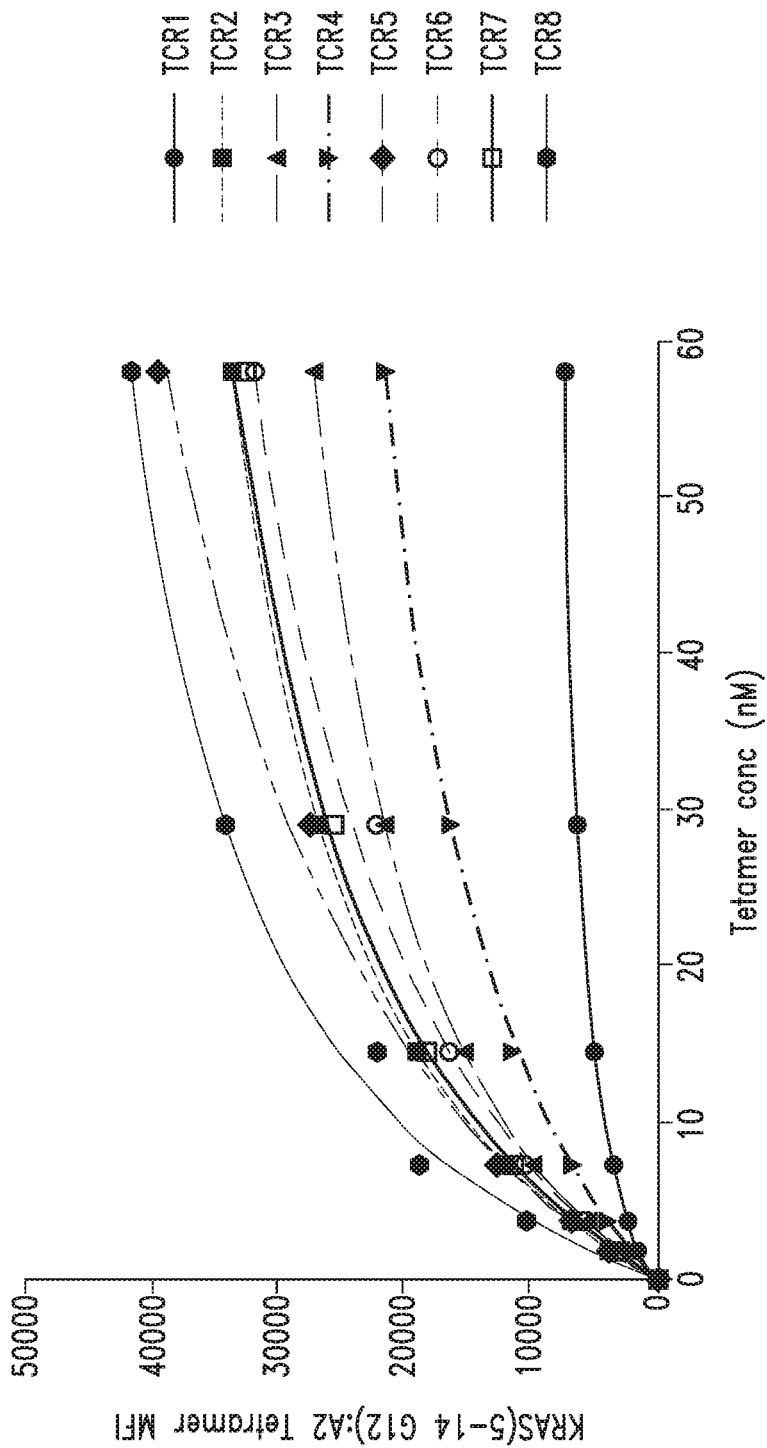
Figure 15B:
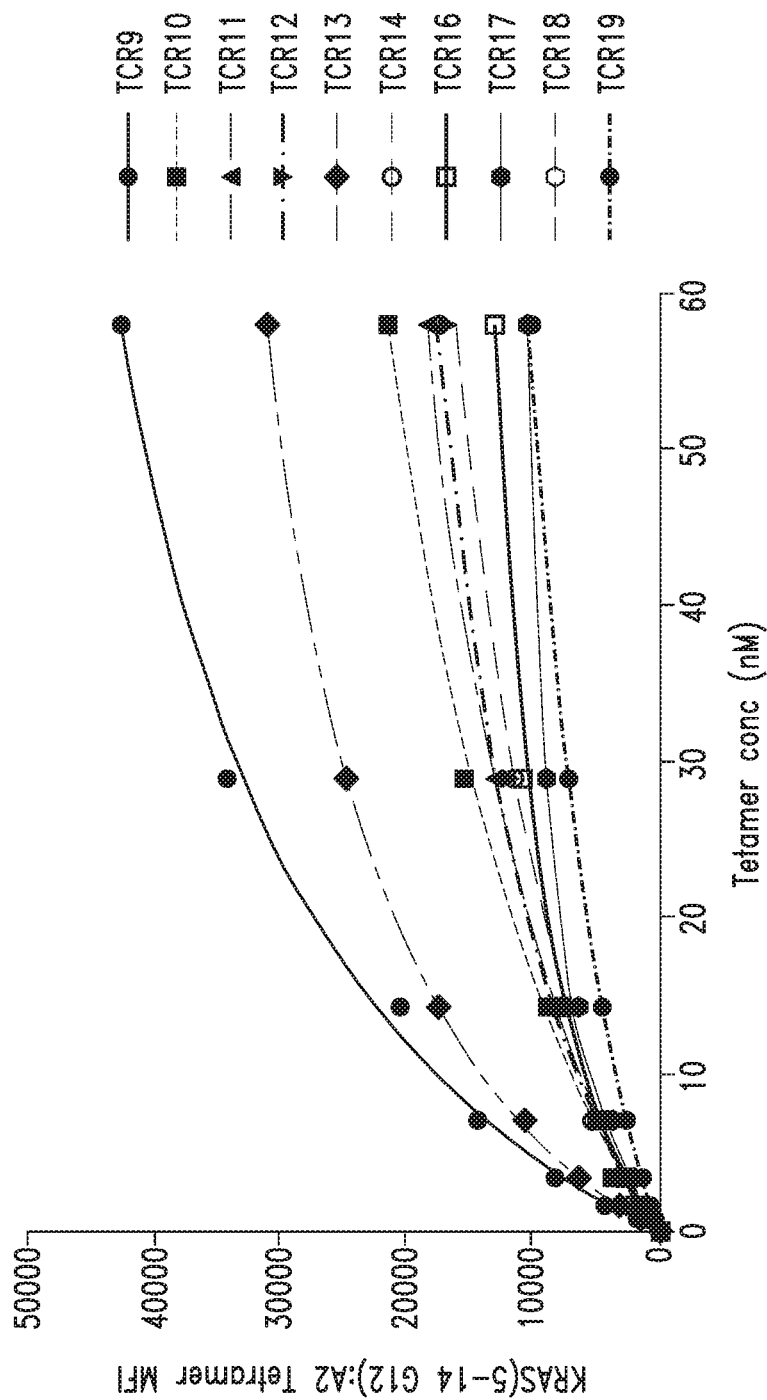
Figure 16:
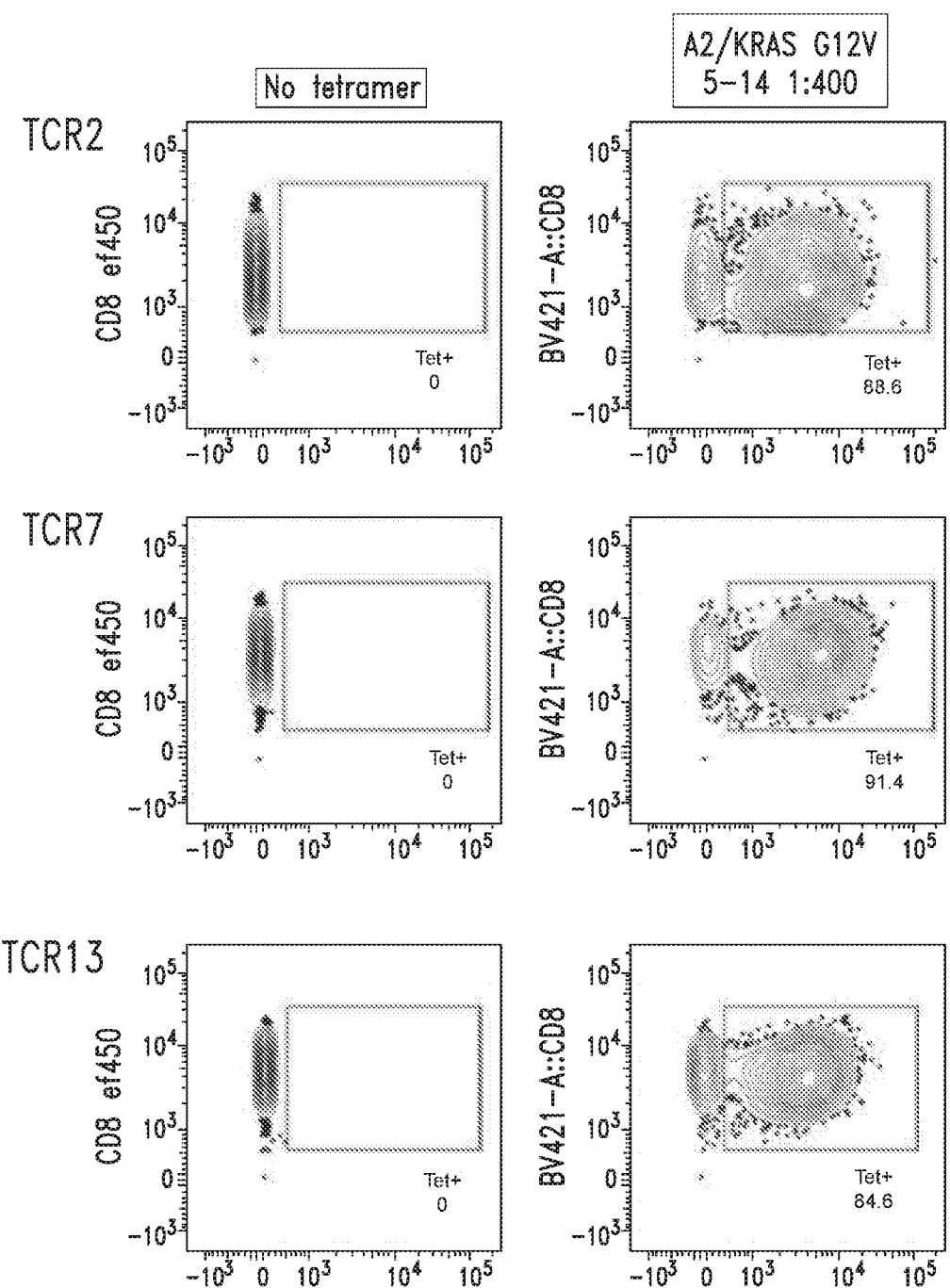
Figure 16:
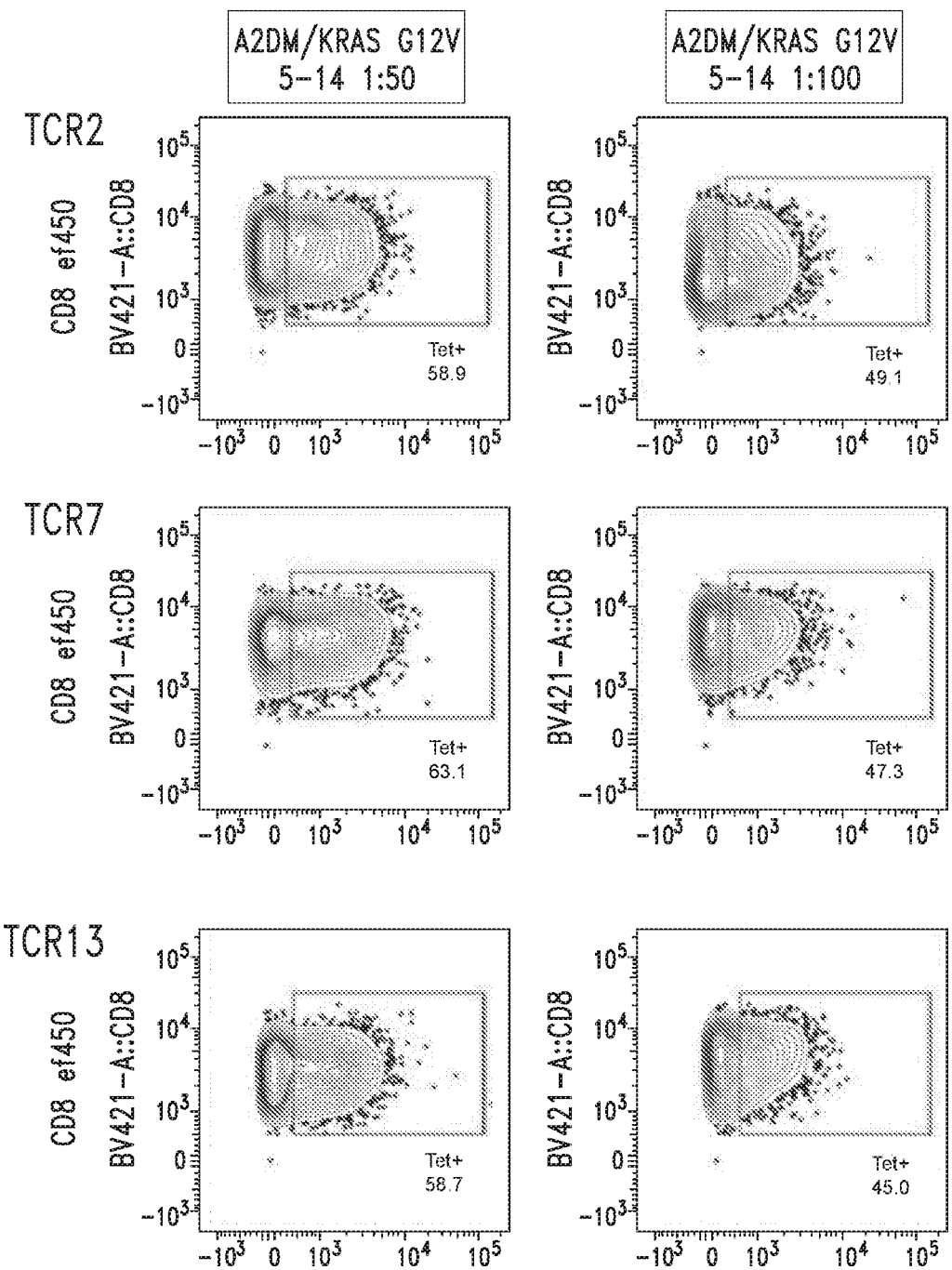
Figure 16:
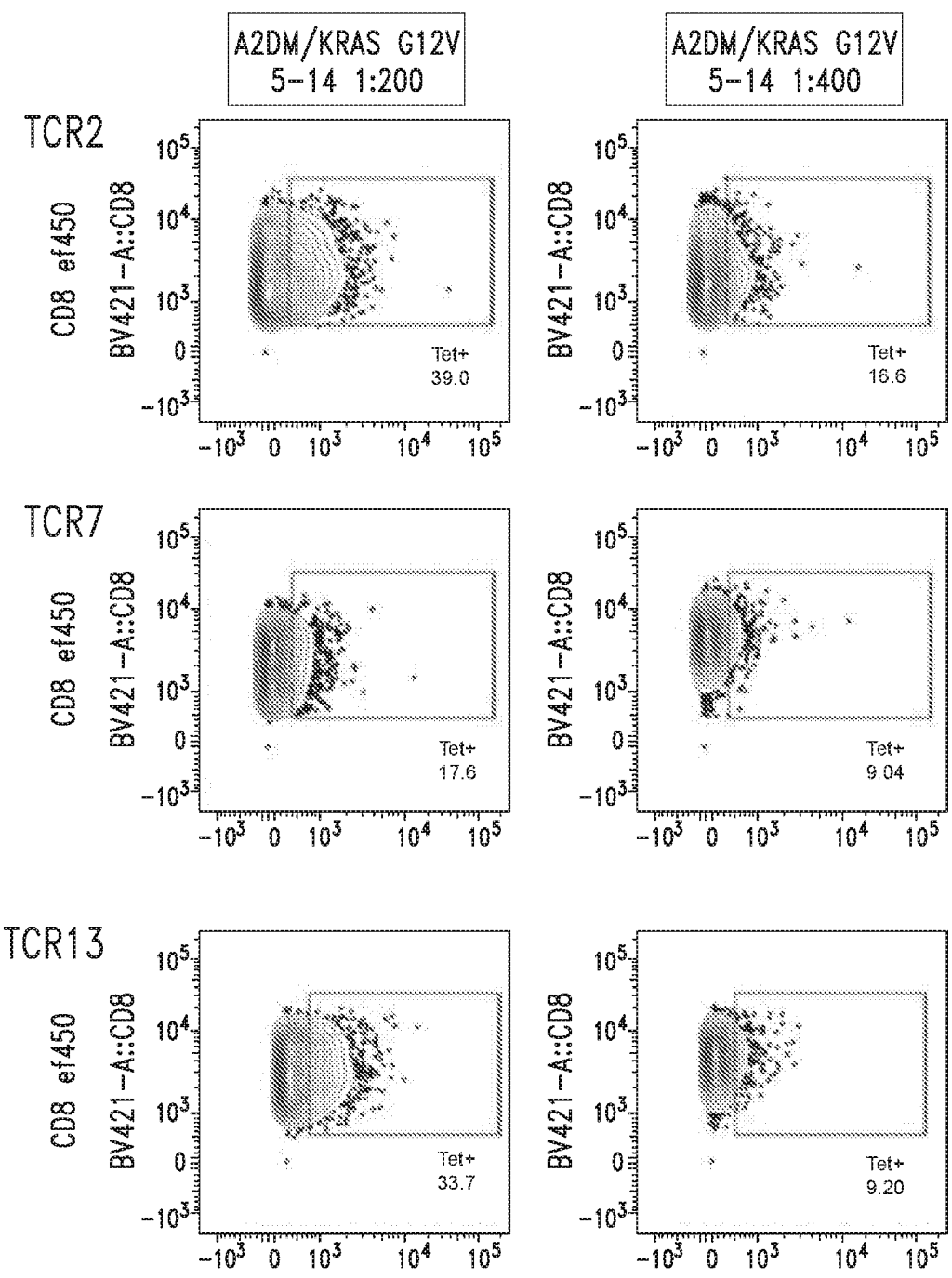

Predicted HLA-binding affinity of mutated KRAS G12V peptides for HLA-A*02:01 was measured using IEDB, and repeated using NetMHCpan, SYFPEITHI, and BiMas (not shown). Results from the IEDB predictions are shown in FIG. 12. T cell lines from healthy donors were stimulated with peptide antigen and examined for CD137 expression (FIGS. 13A and 13B). Next, T cells were tested for the ability to produce IFN-γ in response to peptide antigen. Data are shown in FIGS. 14A-14D. HLA and peptide specificity of the exemplary TCRs was confirmed by tetramer labelling experiments (Mean Fluorescence Intensity when binding to labeled tetramer), as well as relative affinity readings and the ability to bind to tetramer in the absence of CD8. Tetramer labelling MFI data are shown in FIGS. 15A and 15B. The cells can bind to tetramer independent of CD8, as evidenced by follow cytometry data shown in FIG. 16.

Figure 18A:
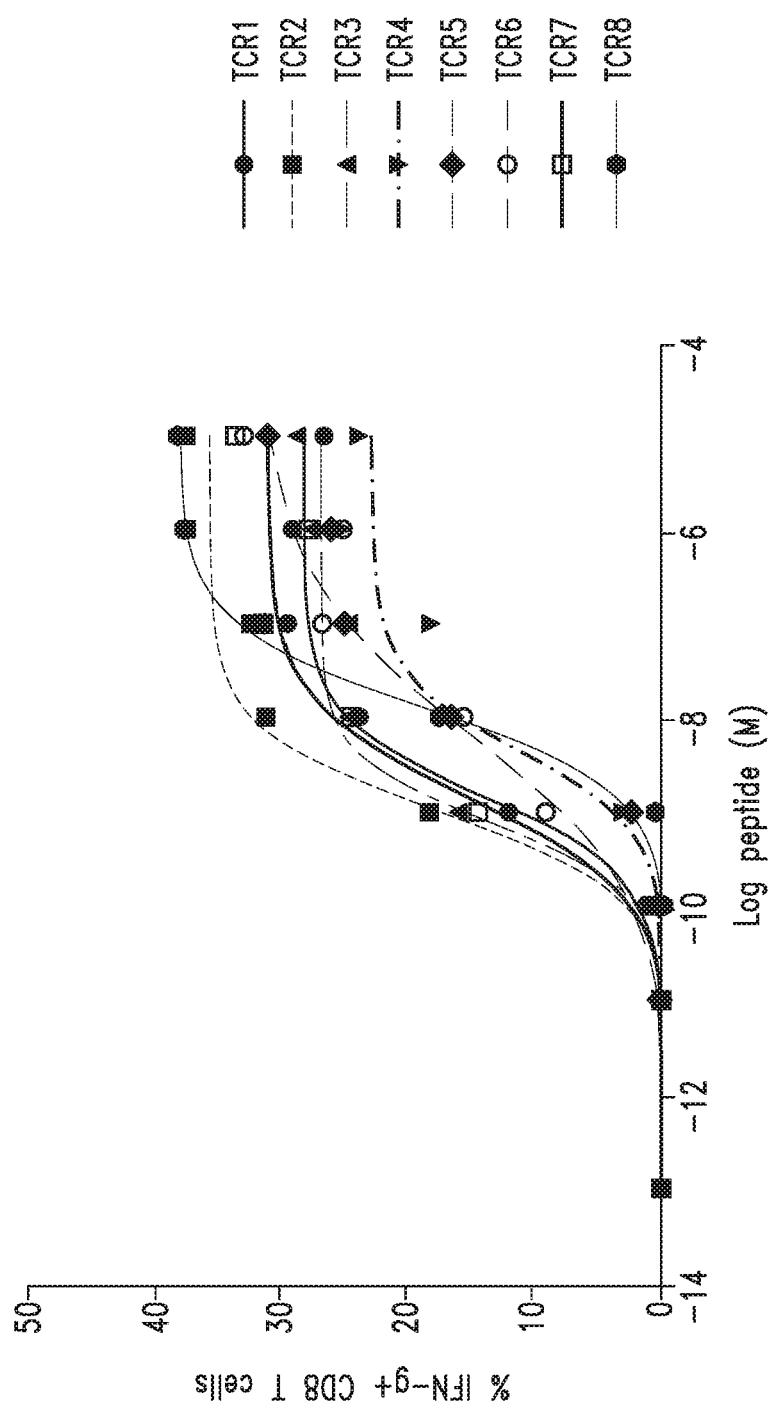
FIGS. 18A and 18B show mutant KRAS$_{5-14}$ G12V peptide avidity curves for the indicated HLA-A2/KRAS-specific TCRs.
Figure 18B:
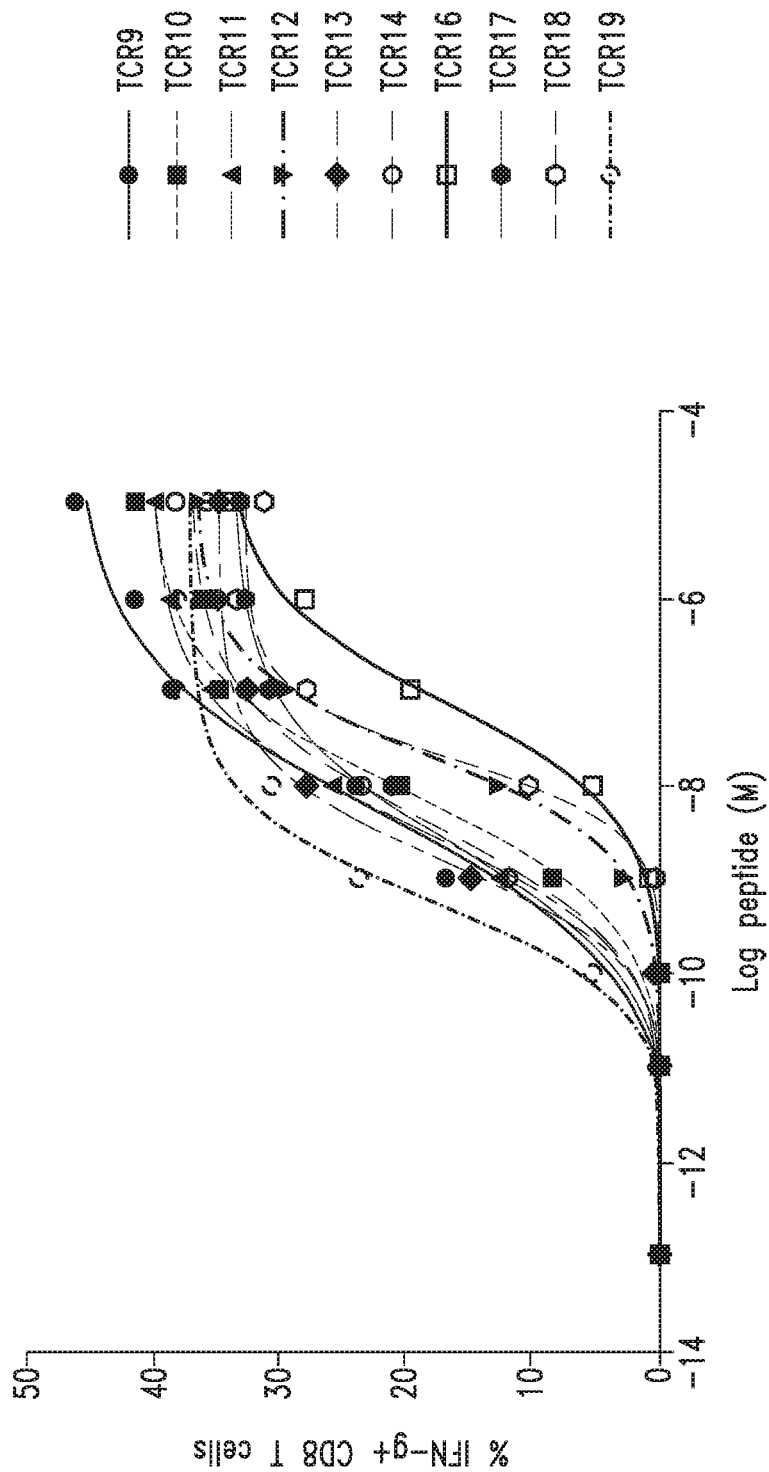
Figure 18C:
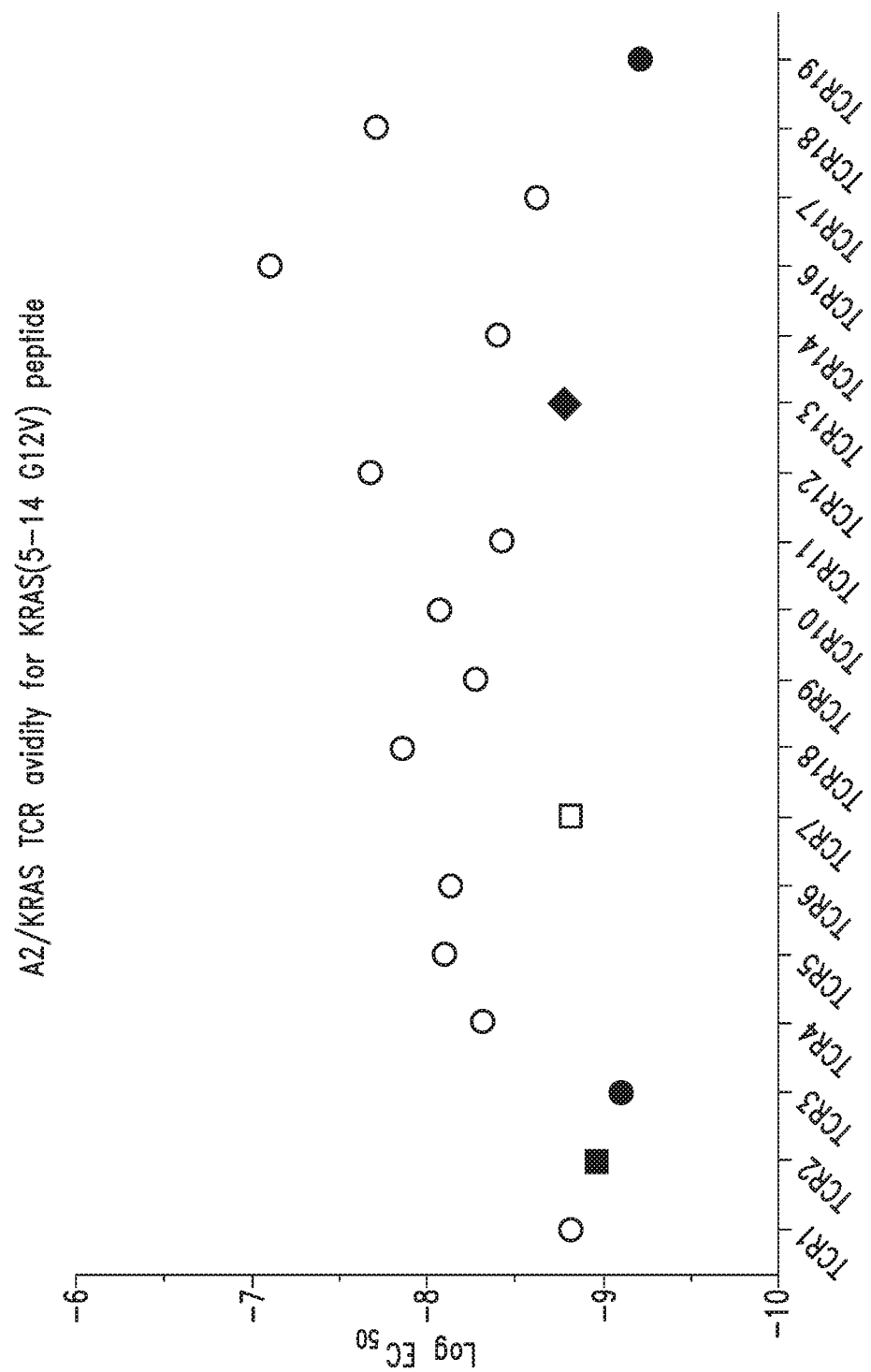

Functional avidity and specificity of the TCR-transduced T cells was tested by peptide-dose response in a 4-hour assay. The data in FIG. 17 show that these T cells are highly specific for, and reactive to, mutant KRAS peptides over wild-type peptide. The data in FIGS. 18A-18C show avidity curves evidencing IFN-γ production by T cells at low levels of peptide stimulation and high calculated avidity.

Figure 19:
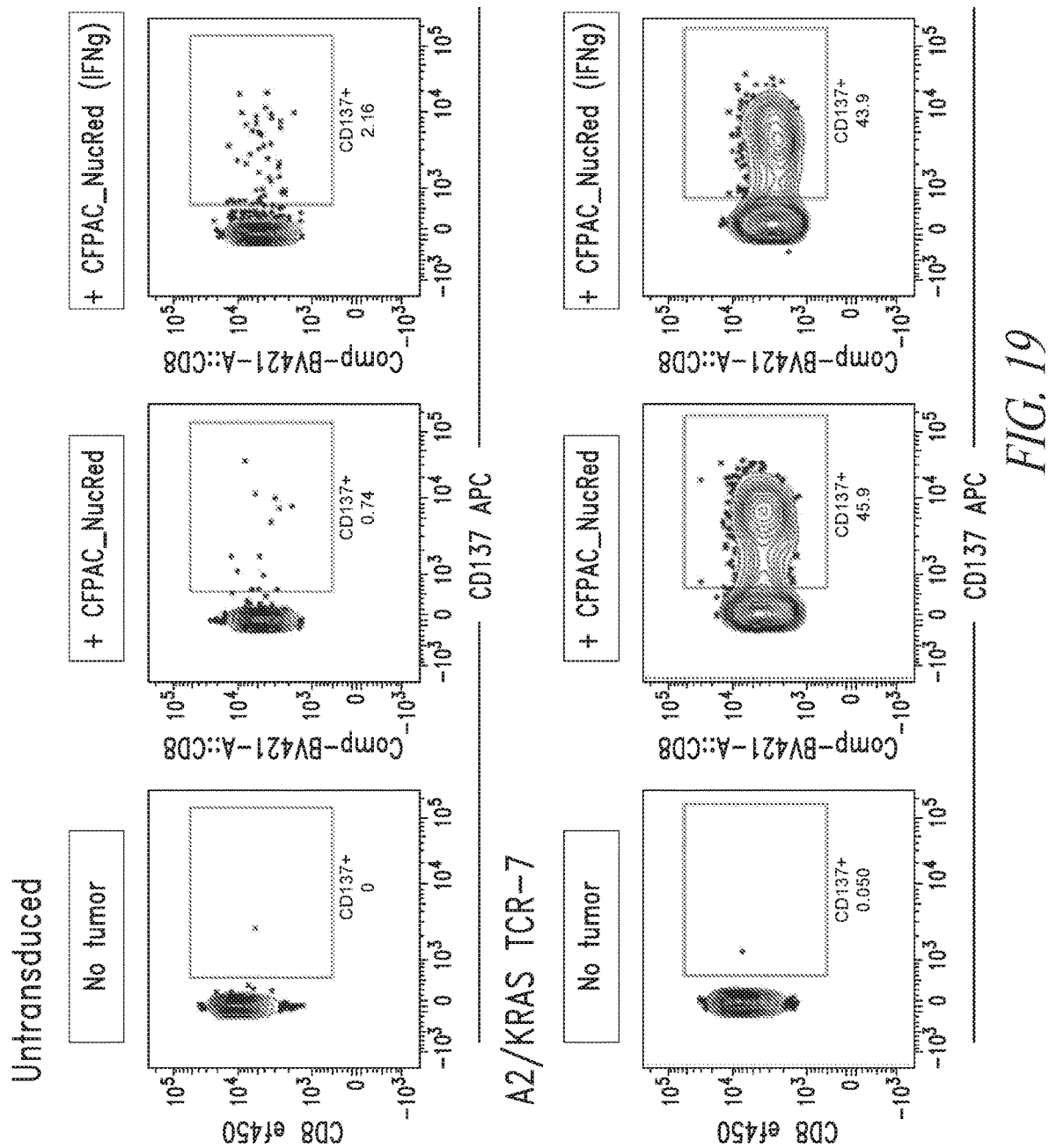

The ability of TCR-transduced T cells to react to endogenously processed and presented peptide was tested by overnight incubation with CFPAC-1 pancreas tumor cells and labelling with CD137/41-BB antibody. Reactivity is shown in FIG. 19.

Figure 20A:
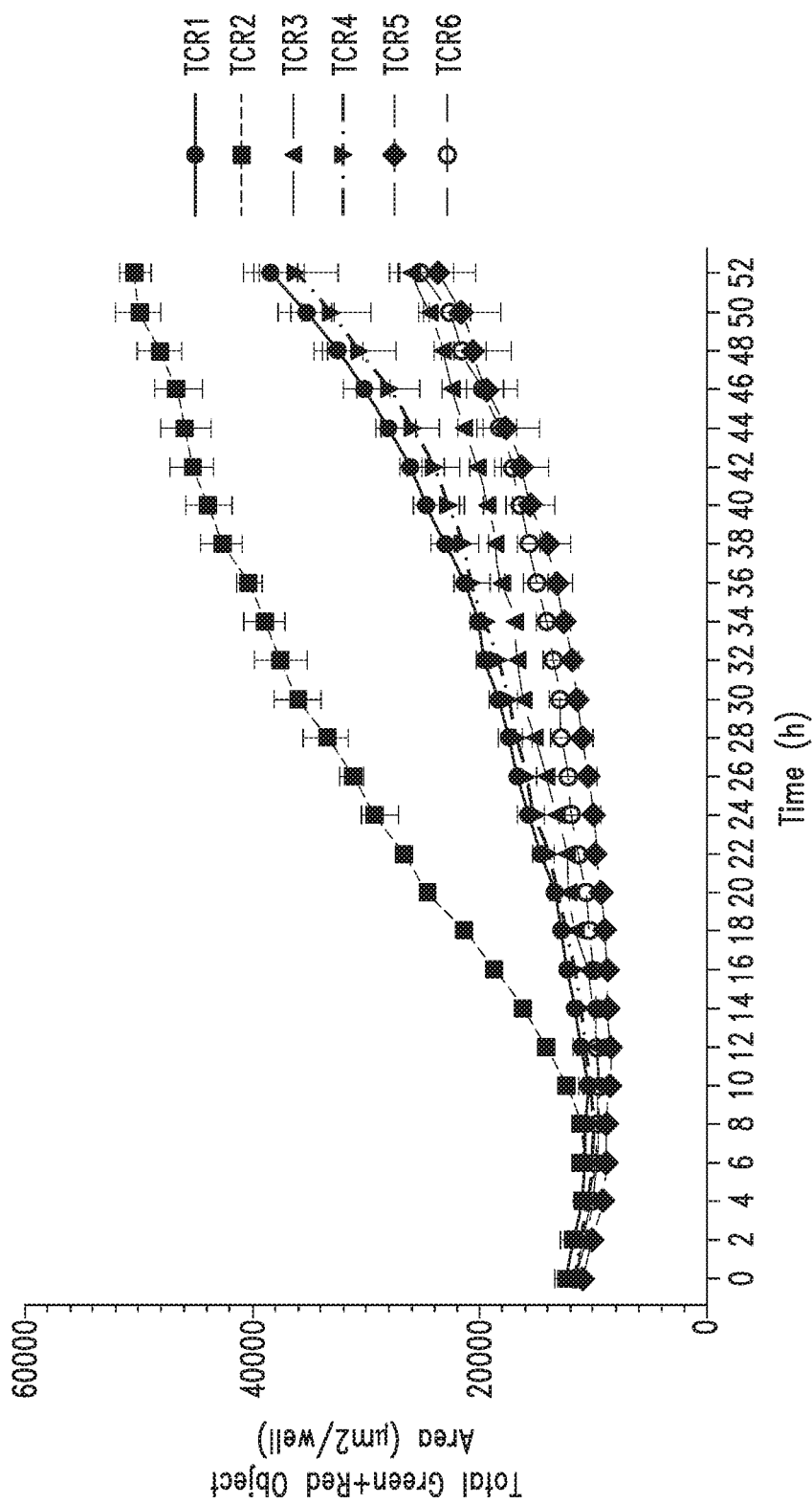
Figure 20A:
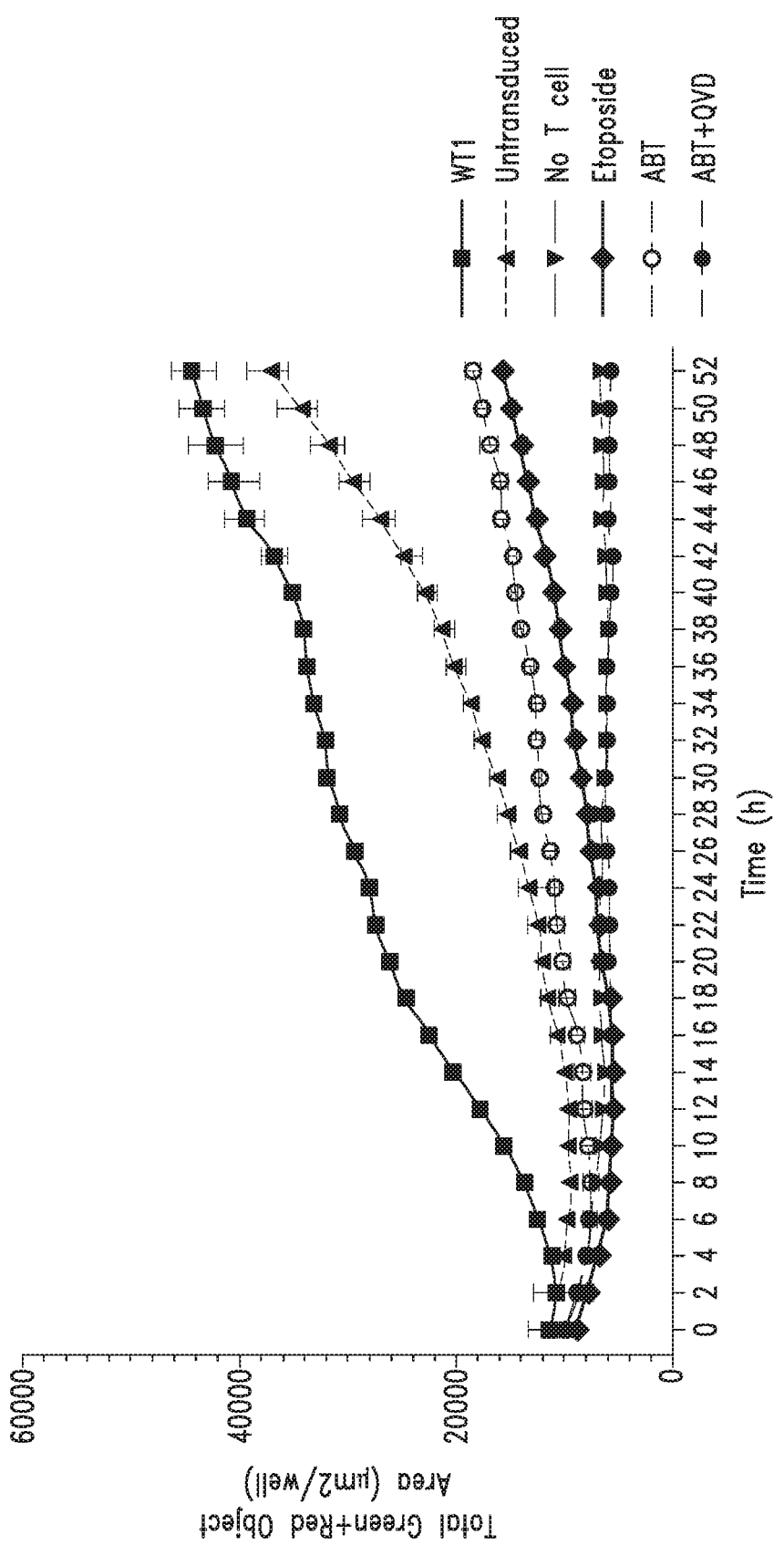
Figure 20B:
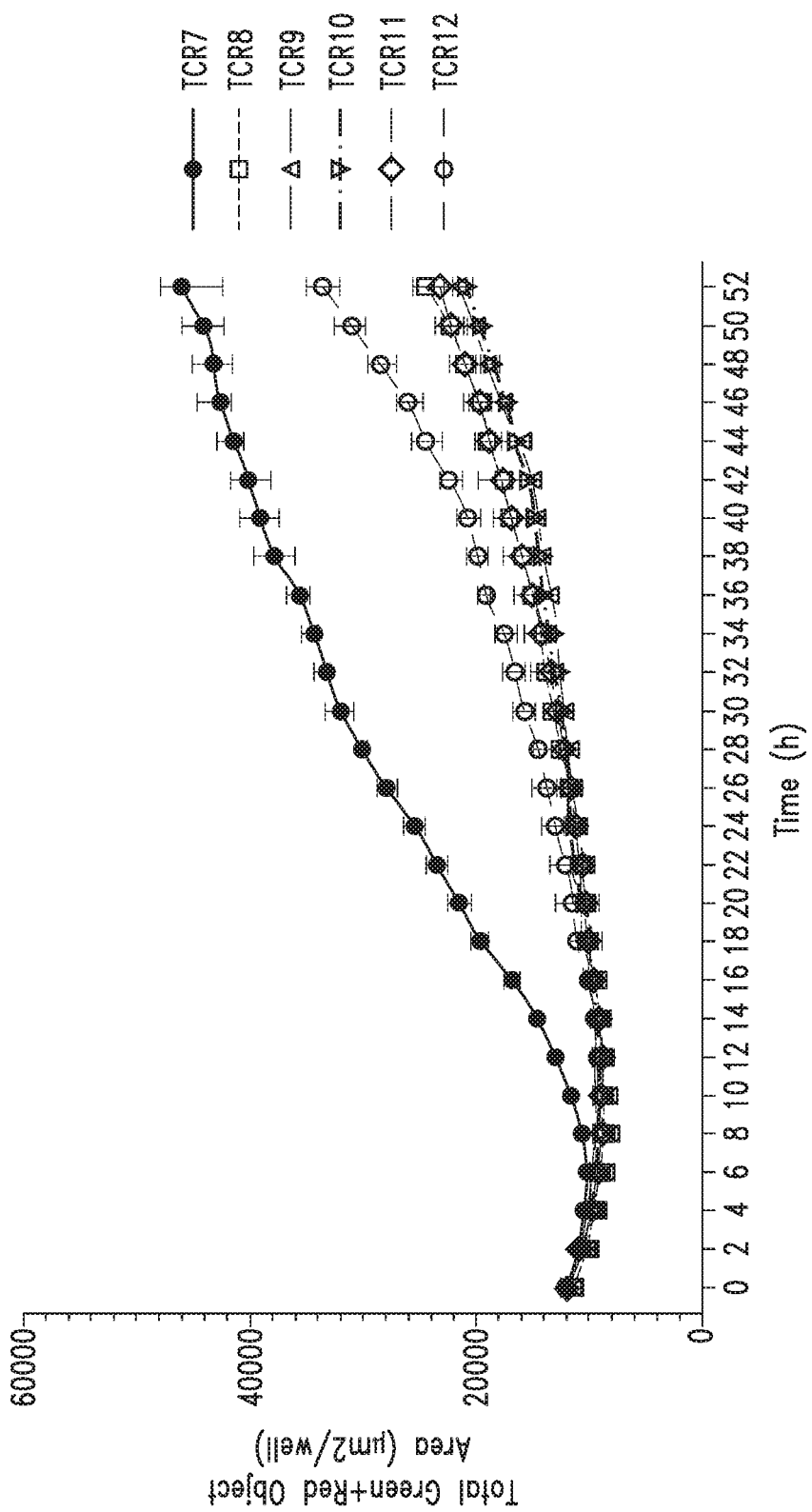
Figure 20B:
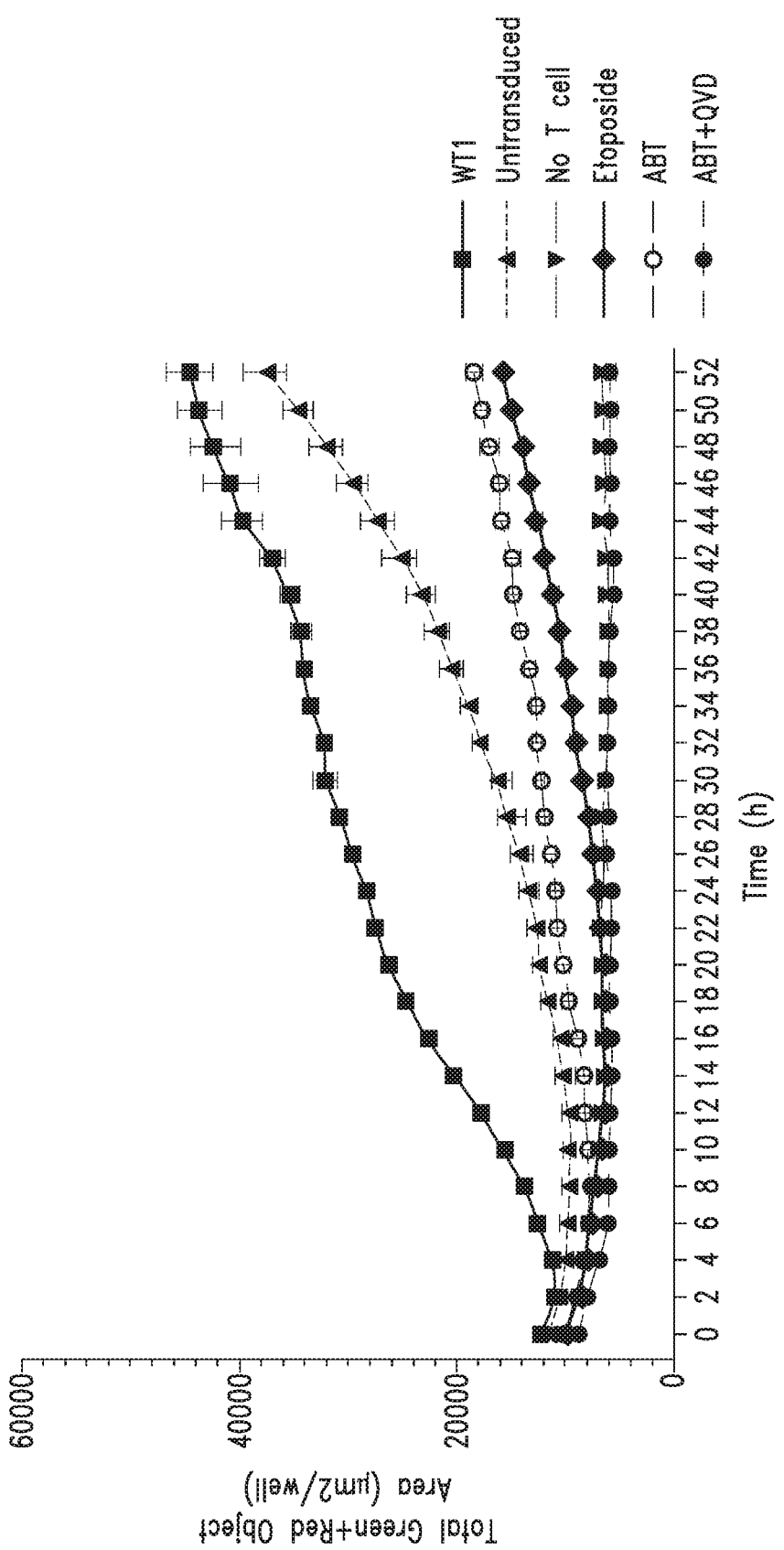
Figure 20C:
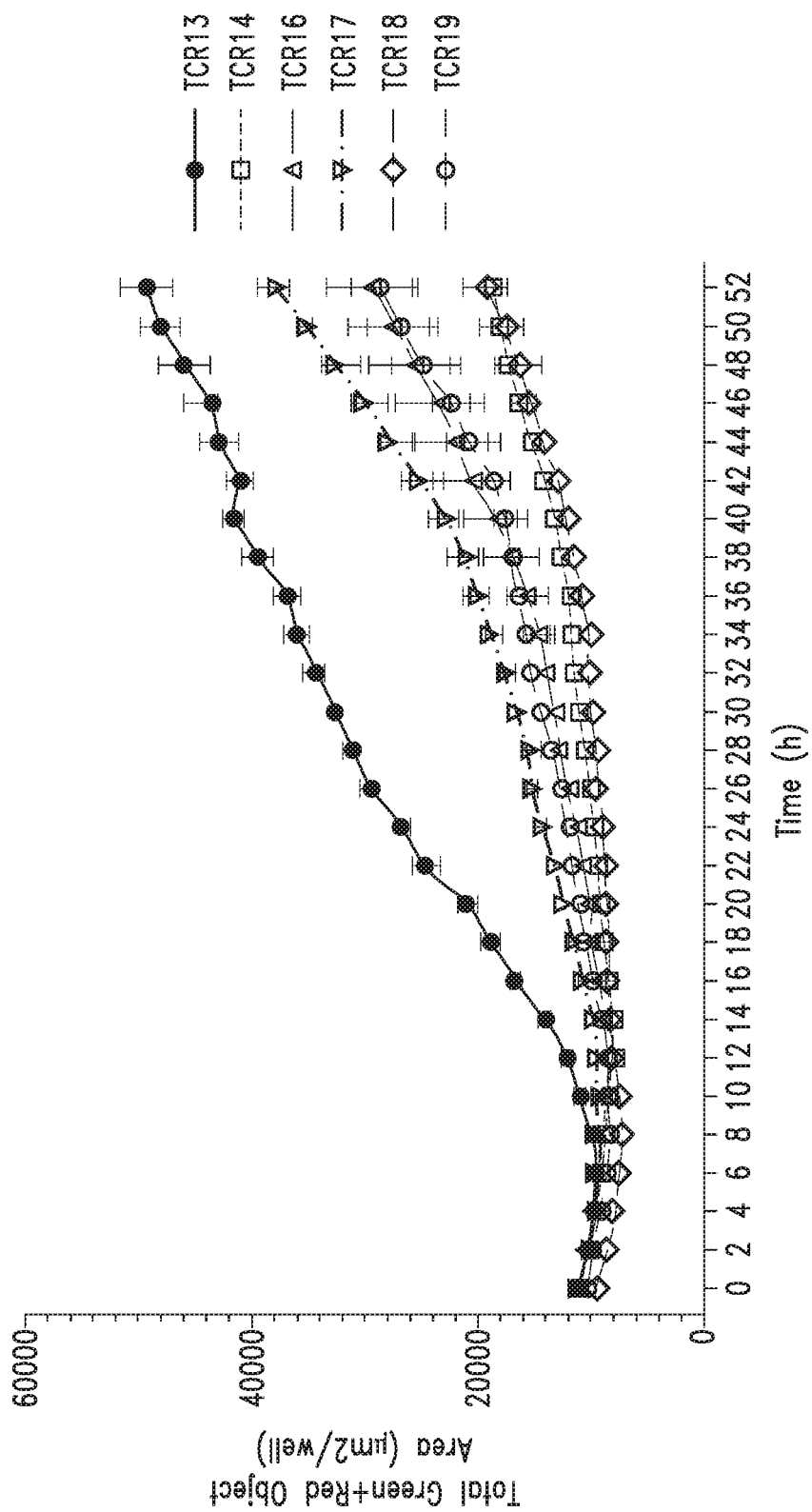
Figure 20C:
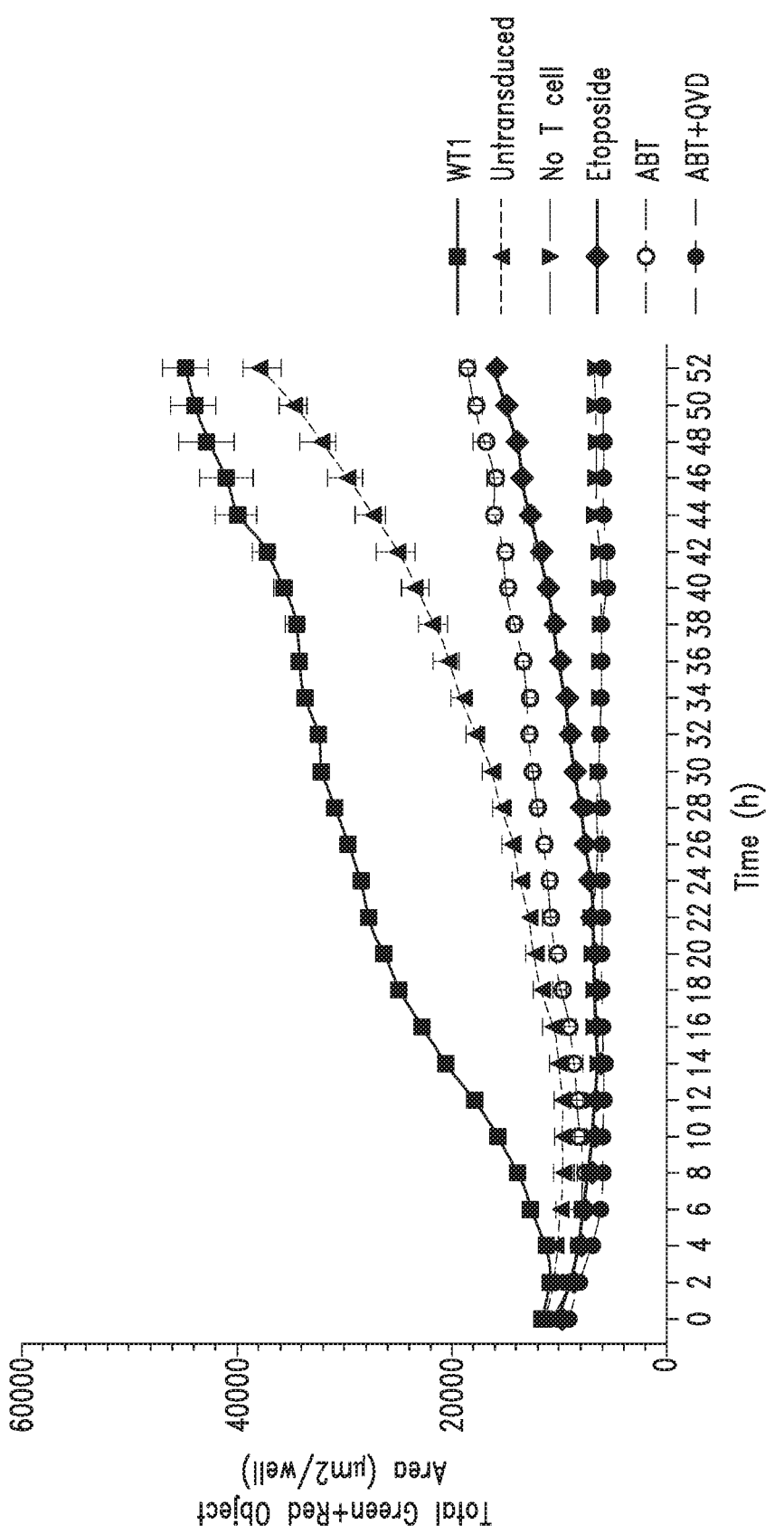
Figure 21A:
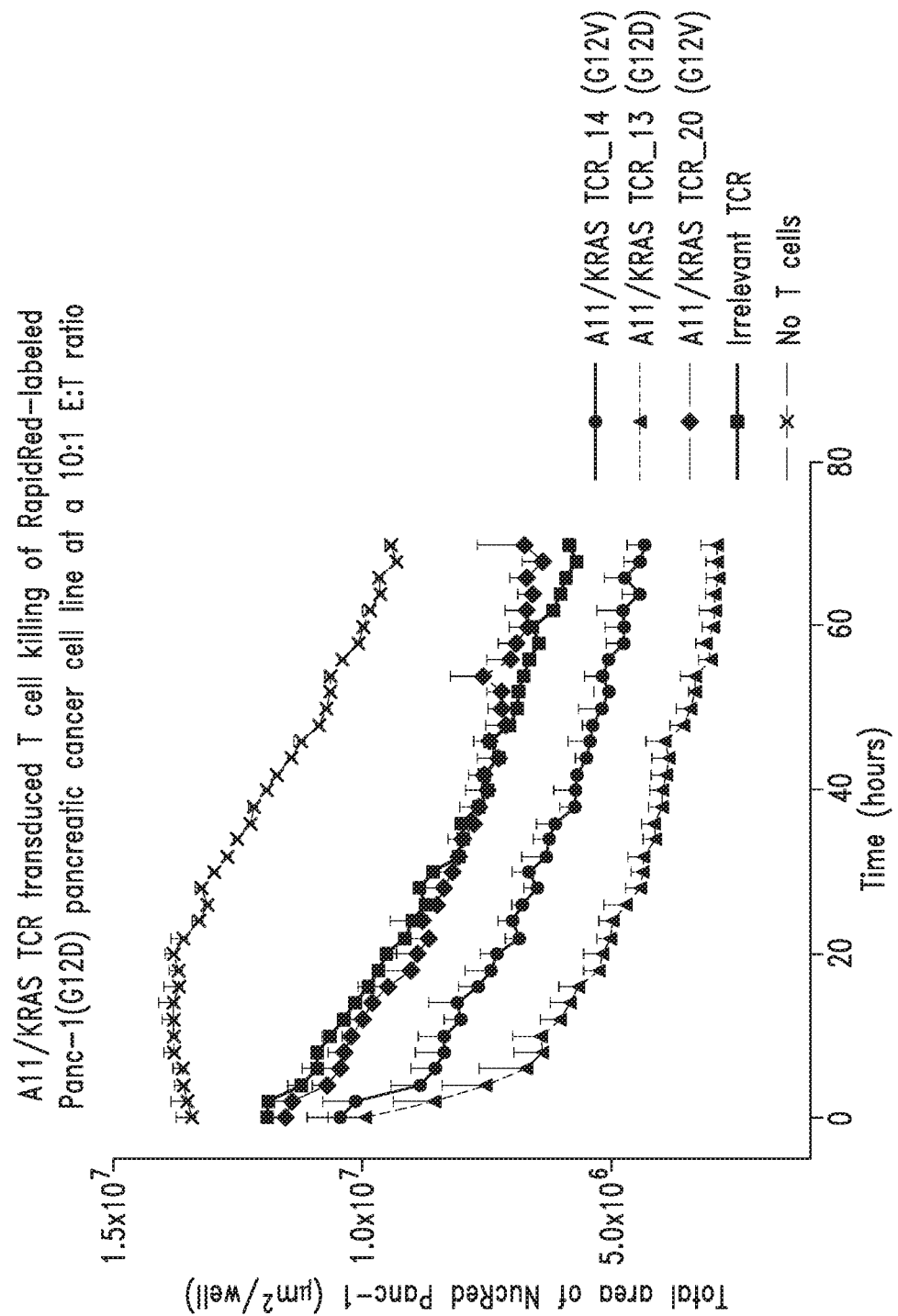
Figure 21B:
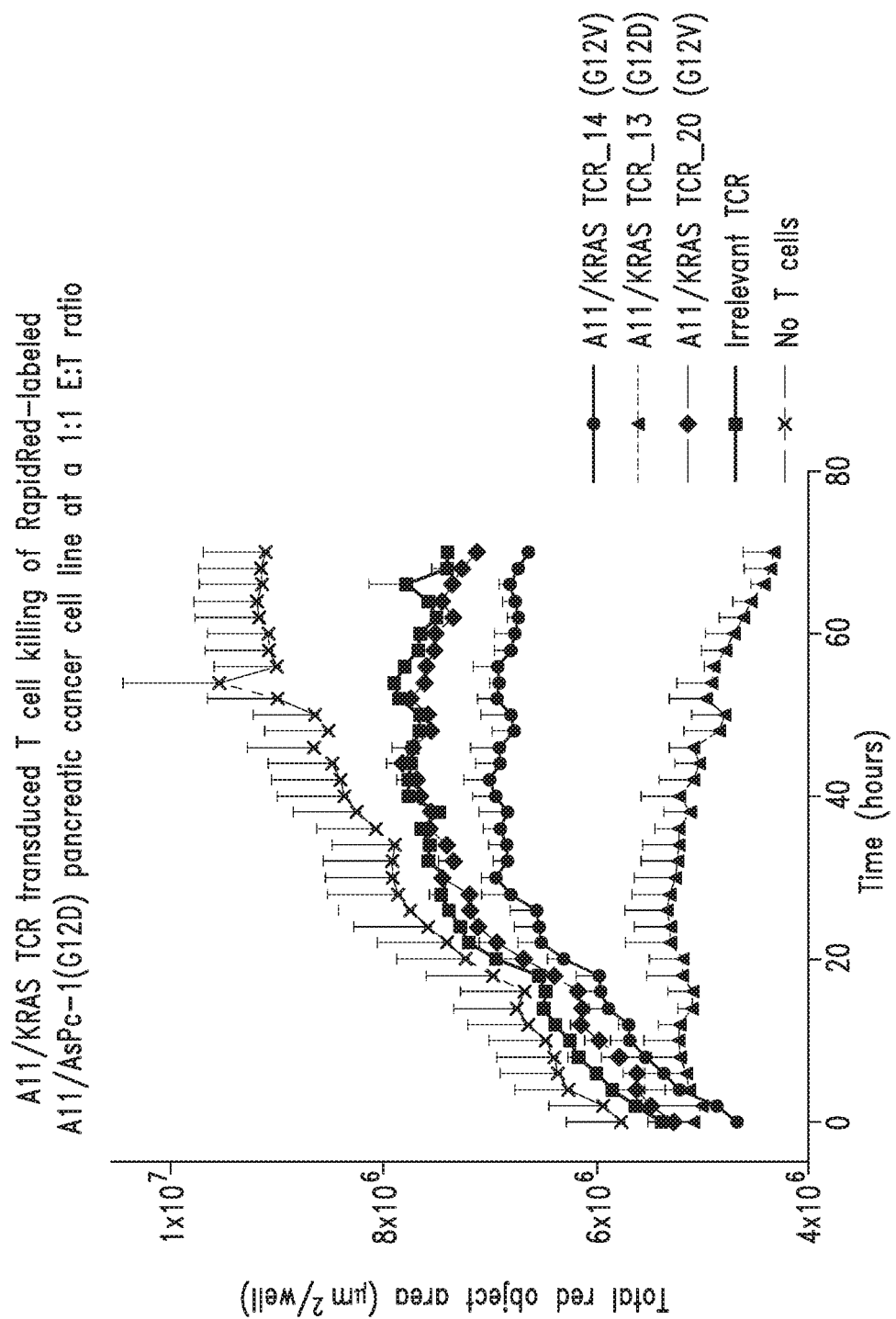
Figure 22A:
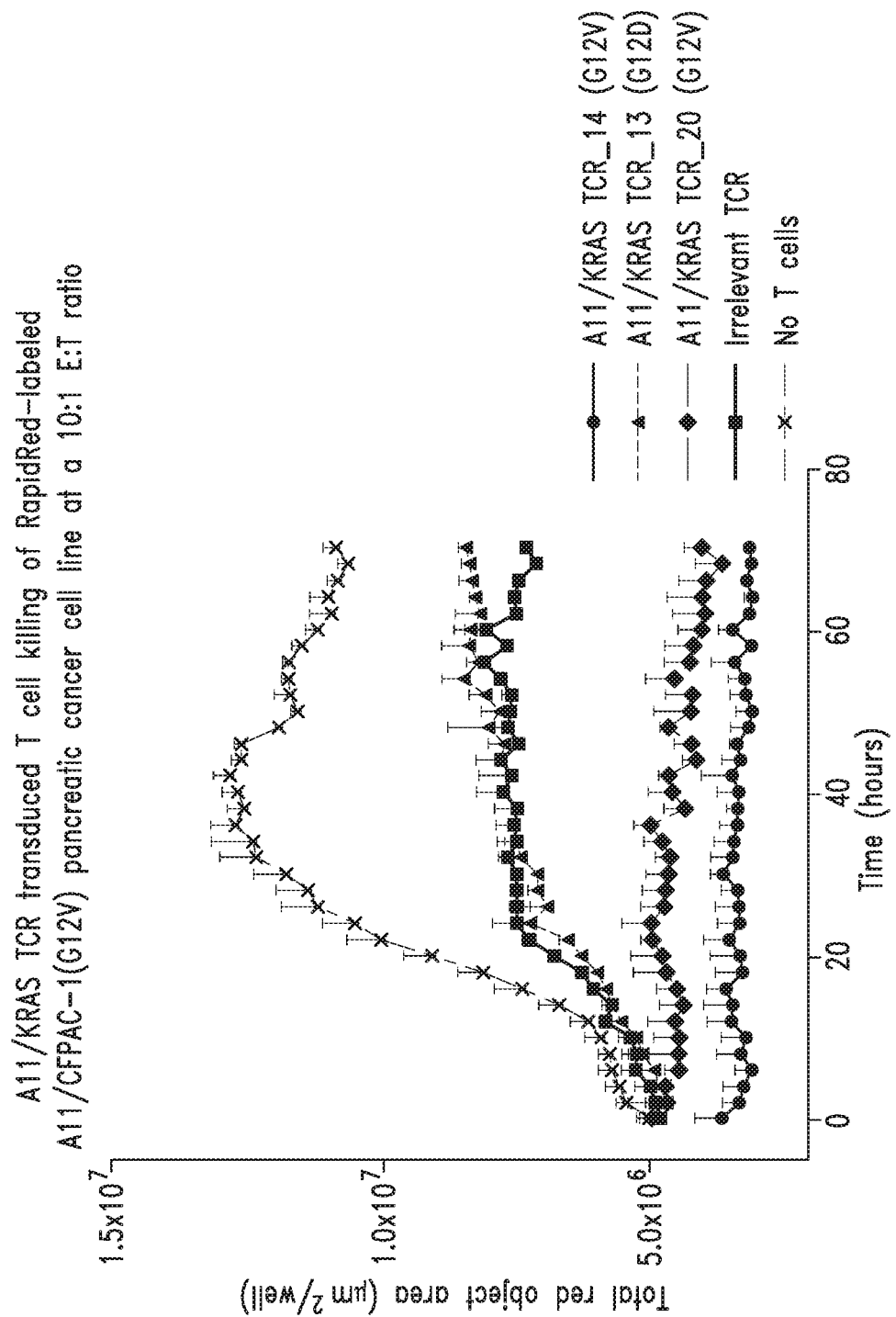
FIGS. 22A and 22B show killing, of RapidRed-labeled pancreatic tumor cell lines having endogenous G12V mutation and transduced HLA-A*11:01 expression, by T cells transduced with the indicated HLA-A11/KRAS-specific TCRs. Data are from IncuCyte® killing assays. (A) CFPAC cell line and a 10:1 effector:target cell ratio were used. (B) A Capan-2 cell line and a 1:1 effector:target cell ratio were used.
Figure 22B:
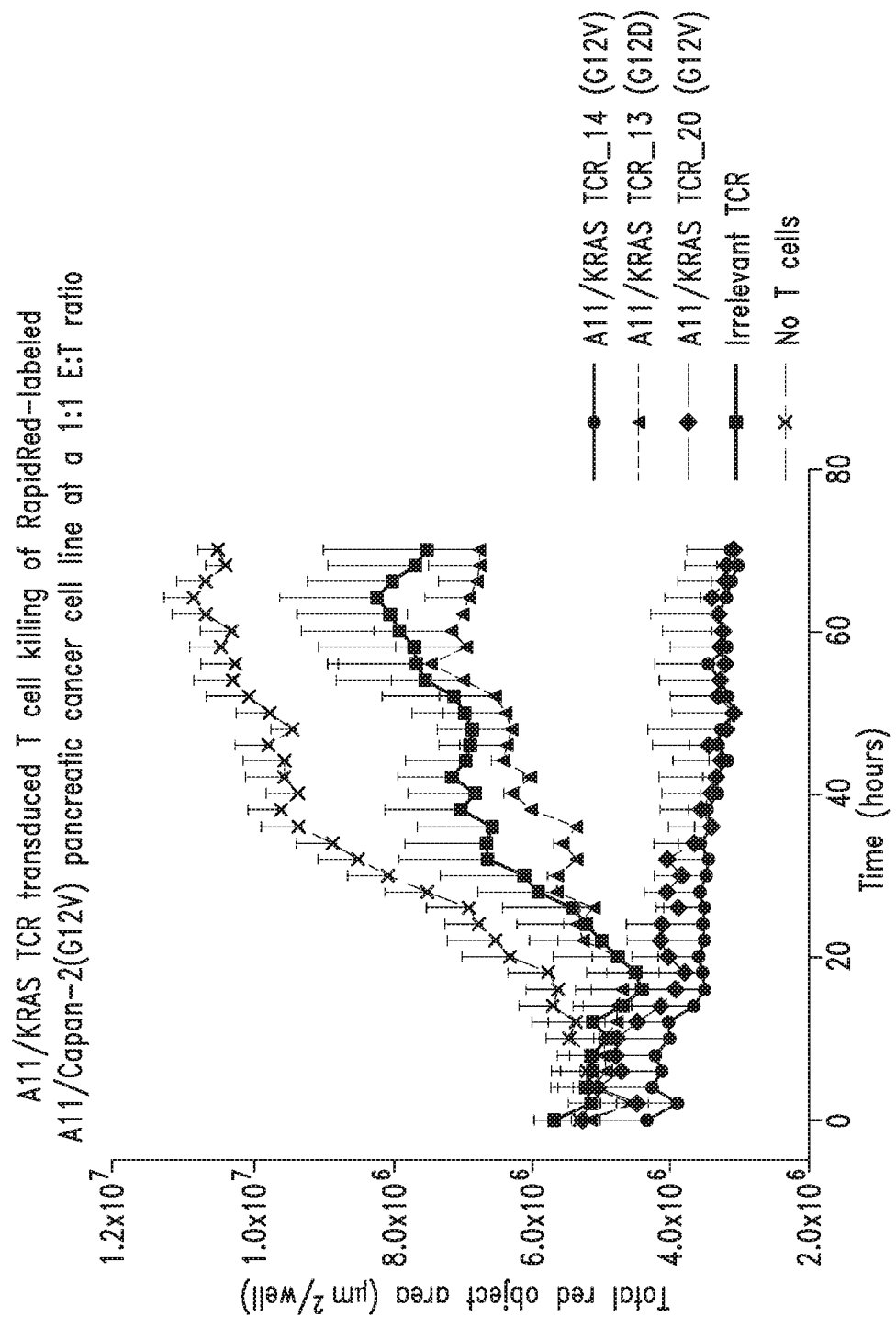

TCR-transduced T cells were tested for the ability to kill CFPAC-1 tumor cell line using an IncuCyte® killing assay. As shown in FIGS. 20A-20C, the transduced T cells effectively killed HLA-A2$^+$ and KRAS G12V$^+$ CFPAC-1 tumor cells.

Example 4

Generation and Characterization of Additional TCRs Specific for Mutant KRAS:HLA-A*11:01

Figure 23A:
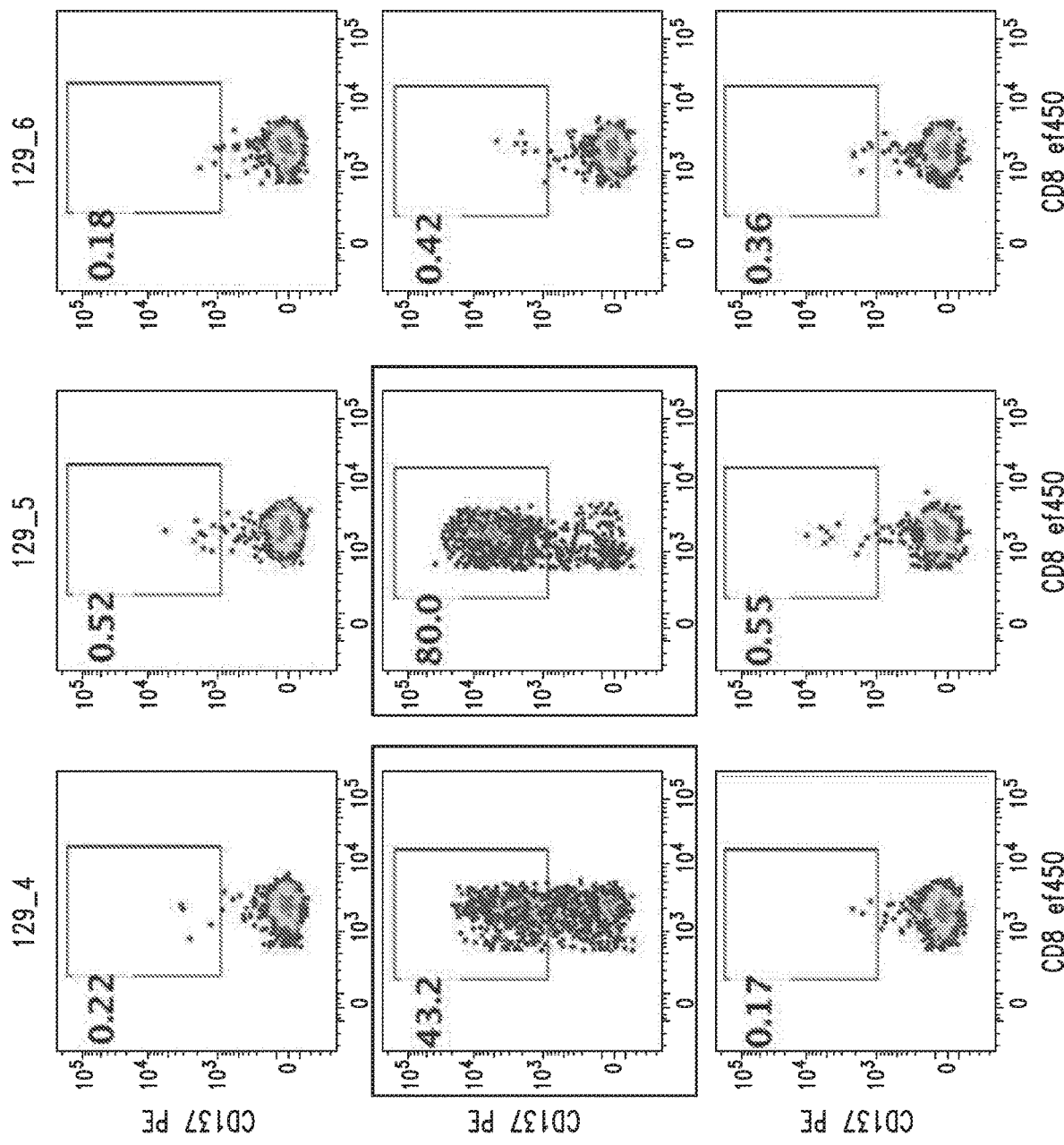
FIGS. 23A and 23B provide flow cytometry data from an initial screen ("Sort 2a" for HLA-A11/KRAS-specific TCRs) showing CD137 labelling of exemplary HLA-A11/KRAS-specific TCR-transduced CD8$^+$ T cells after overnight stimulation with 1 μg·mL wild-type or mutant KRAS peptide.
Figure 23A:
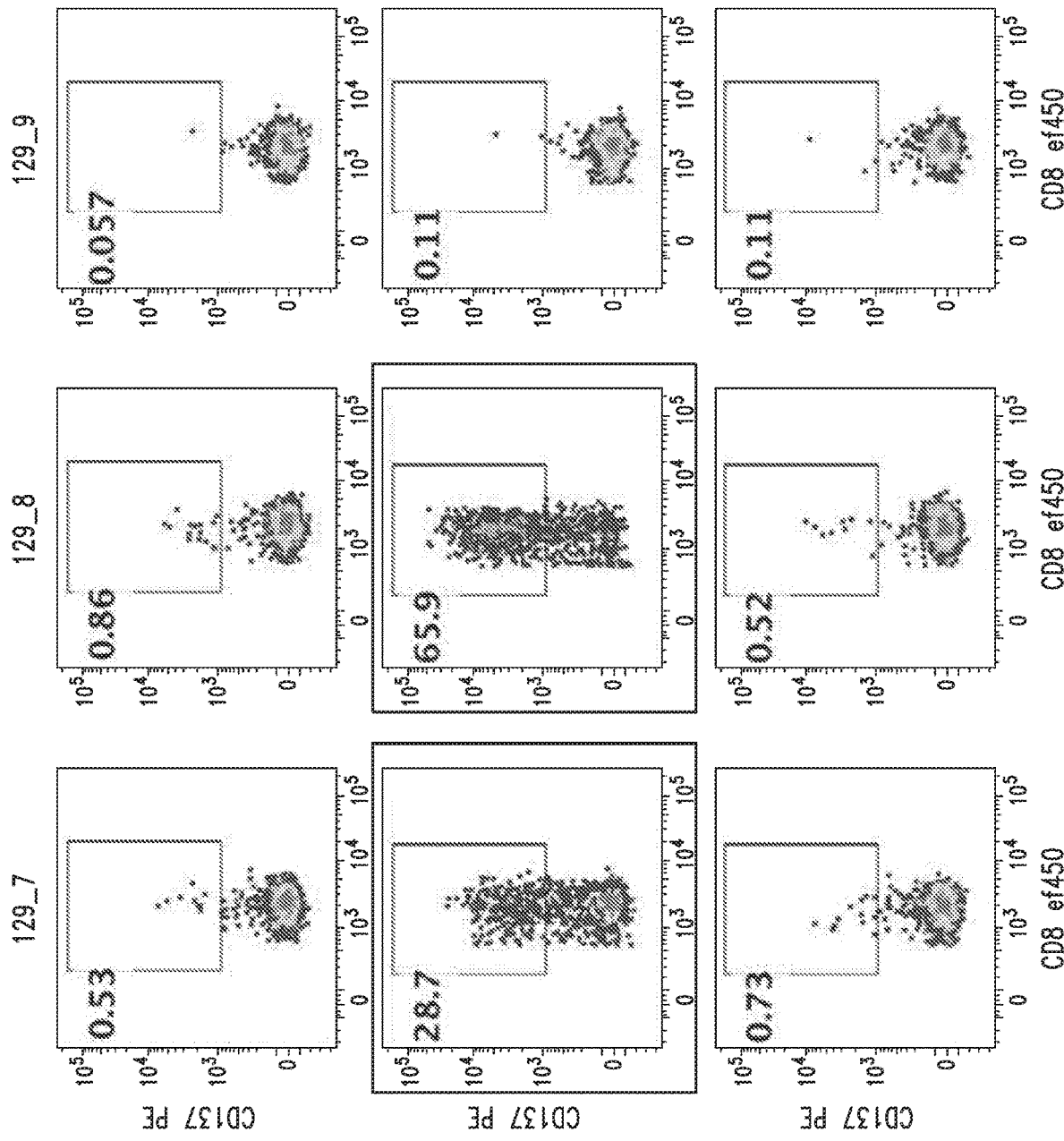
Figure 23B:
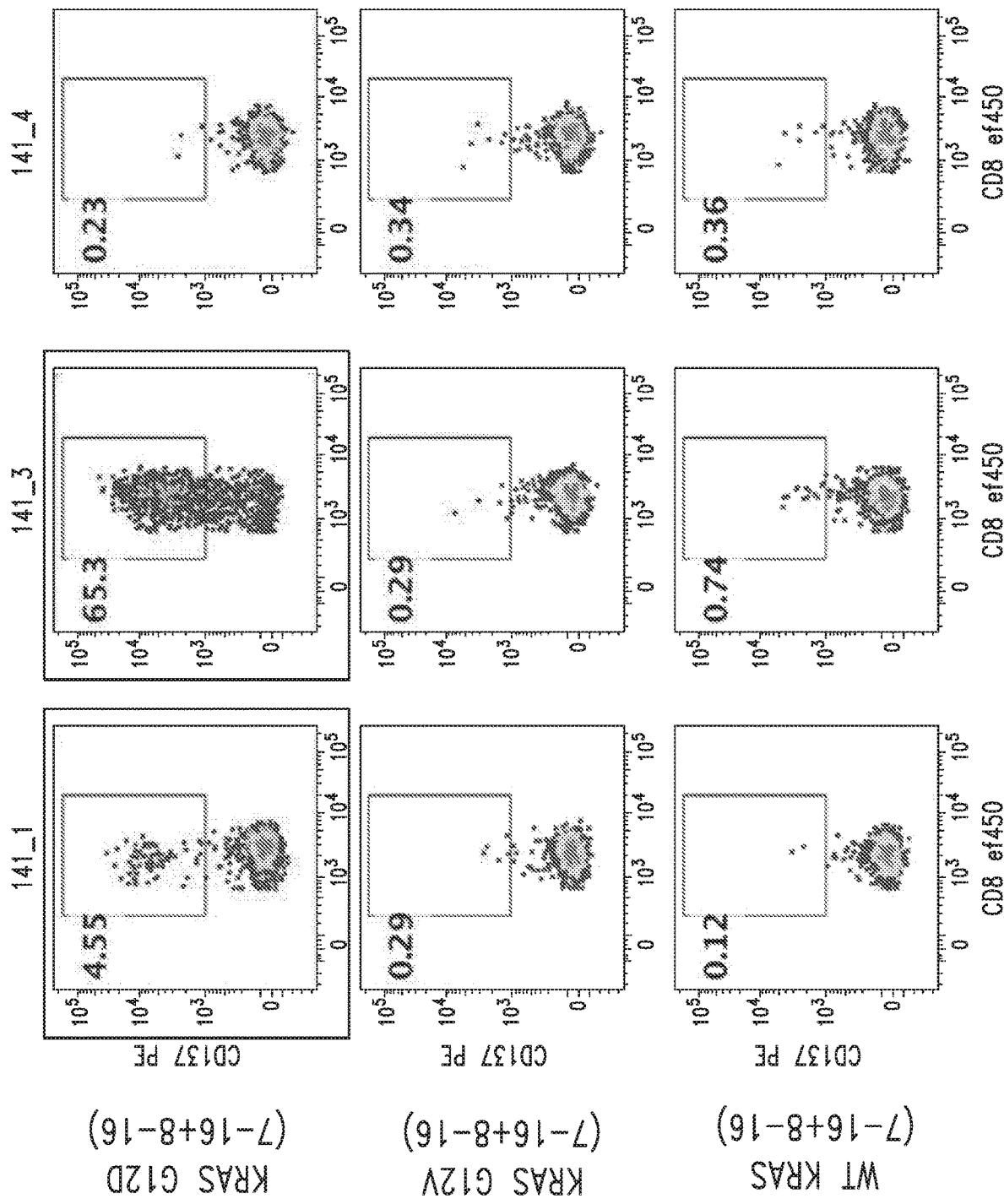
Figure 23B:
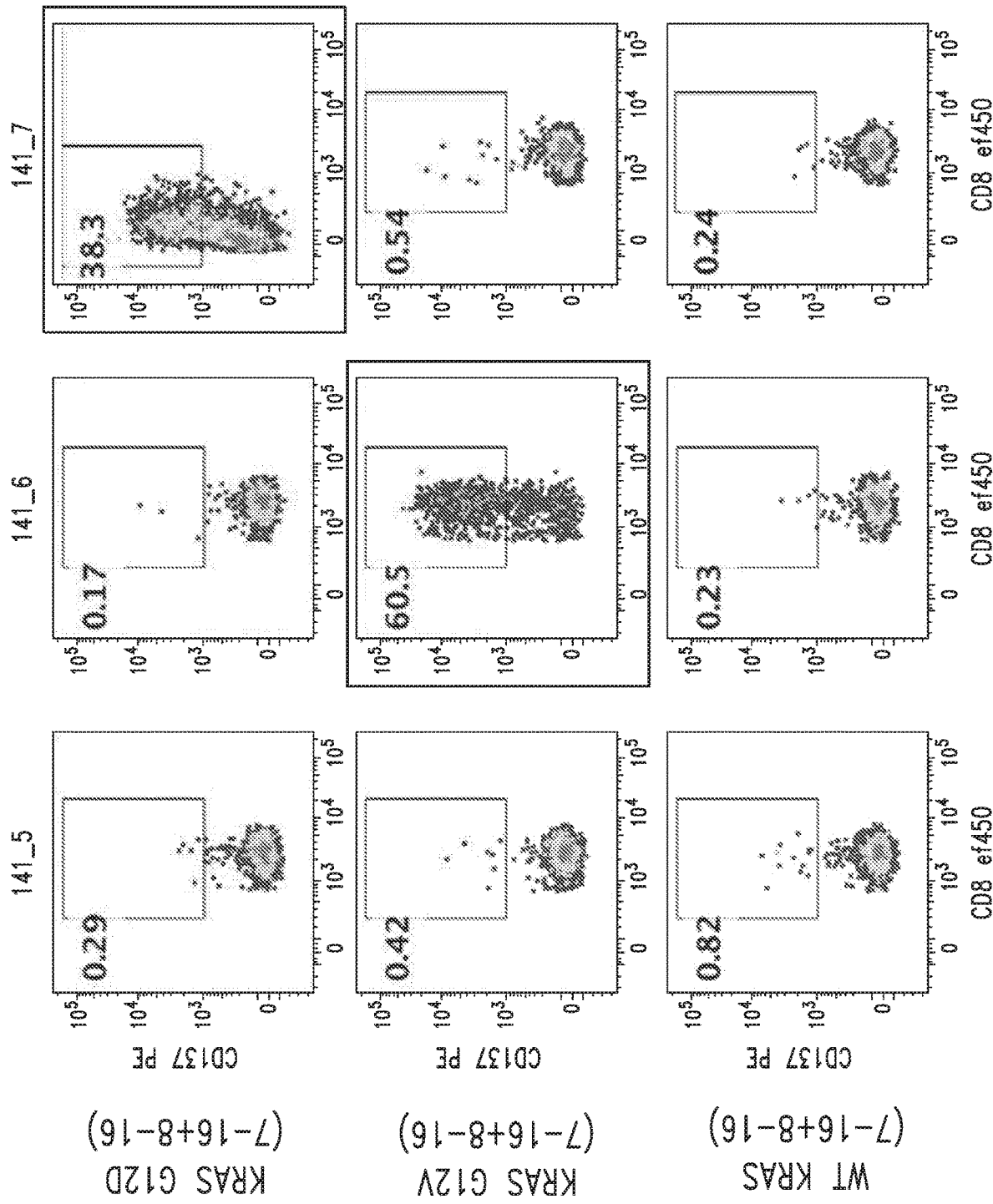
Figure 23B:
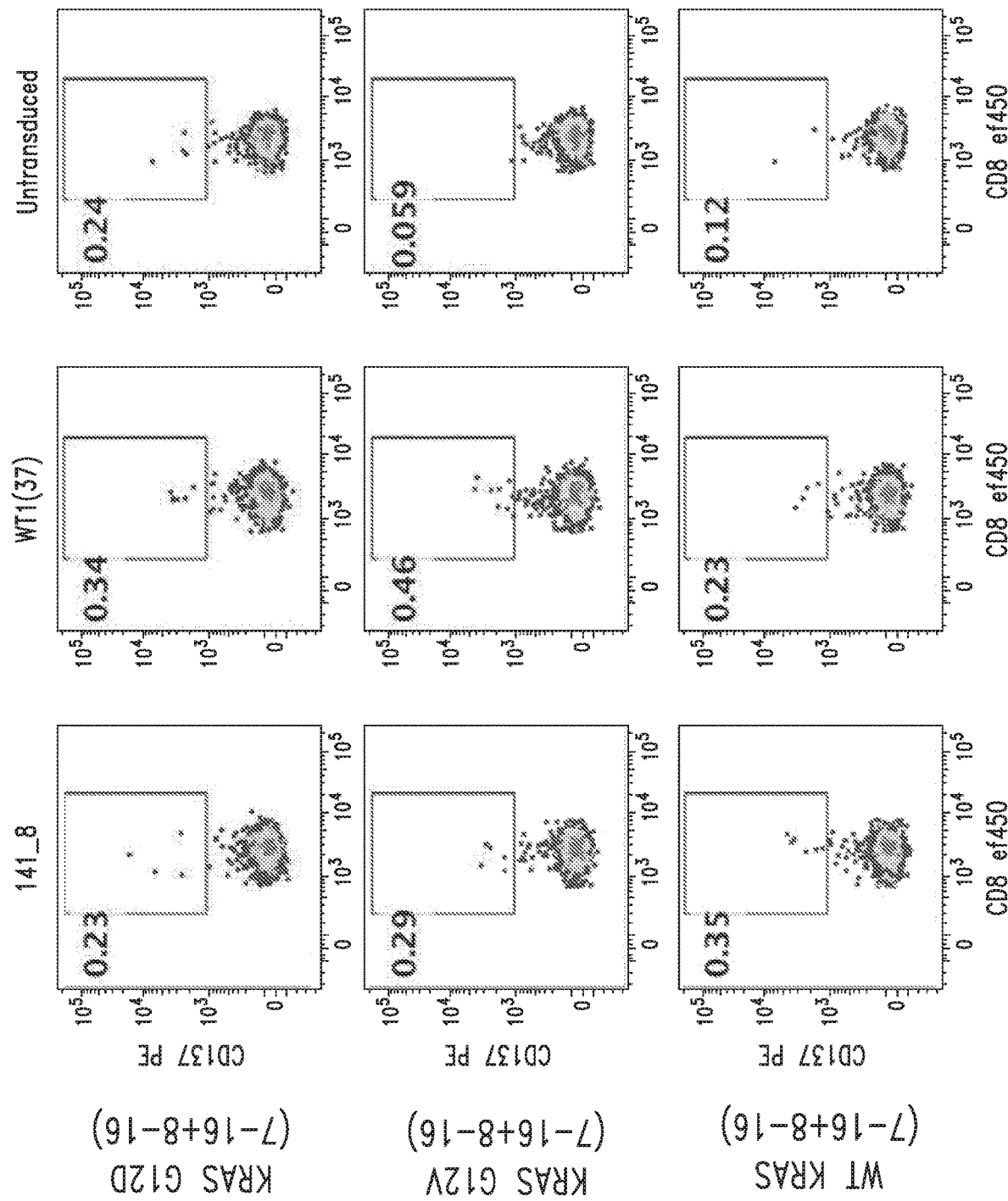
Figure 24A:
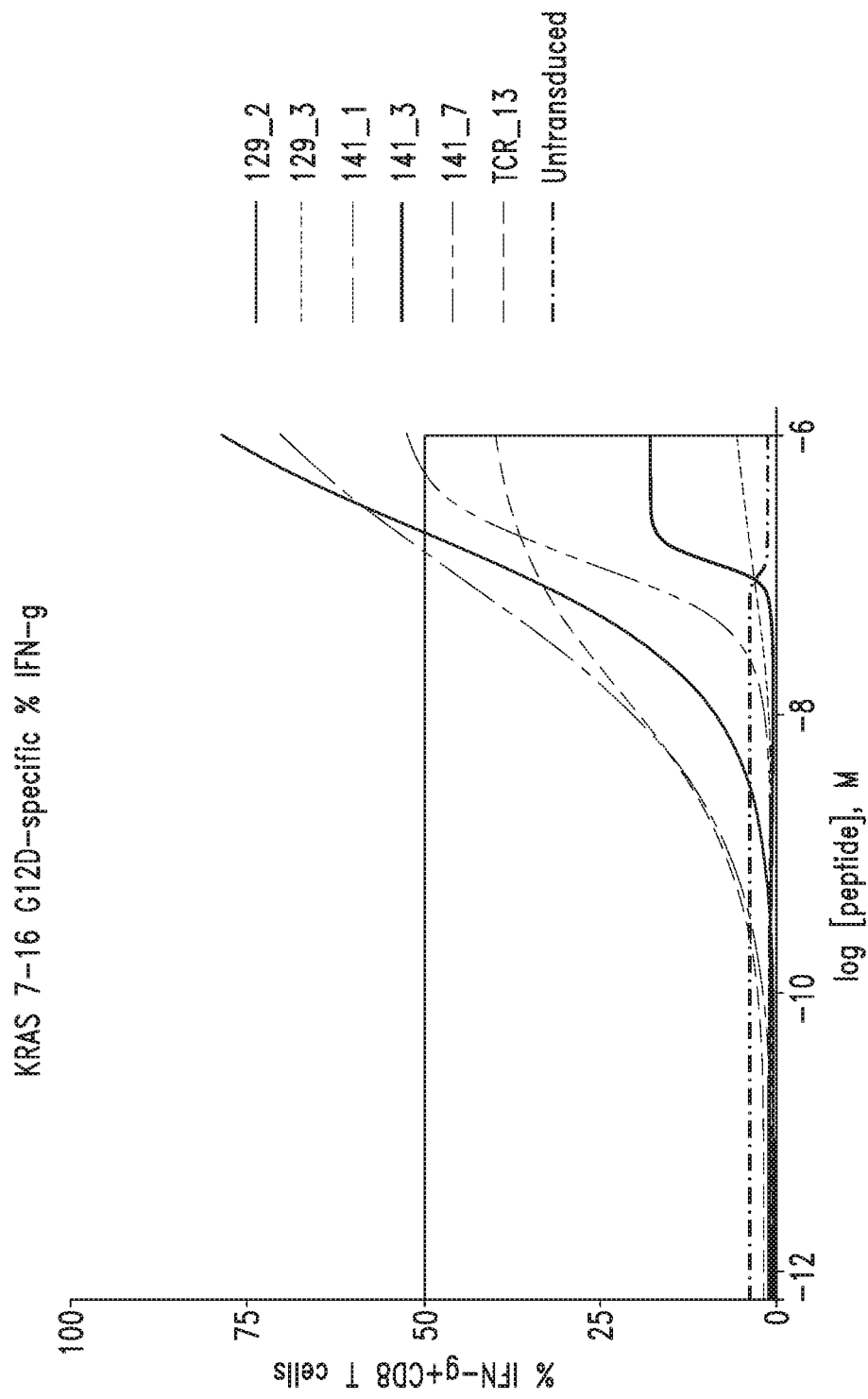
FIGS. 24A-24C provide flow cytometry data showing log$_{10}$ EC50 for IFN-γ labelling of exemplary HLA-A11/KRAS TCR-transduced, sorted and expanded CD8$^+$ T cells after 4 h stimulation with a dose titration of G12D-mutant KRAS peptides: (A) KRAS$_{7-16}$ G12D peptide; (B) KRAS$_{8-16}$ G12D peptide; (C) KRAS$_{7-16}$ G12D log$_{10}$ EC50 of T cells transduced with the indicated TCR.
Figure 24B:
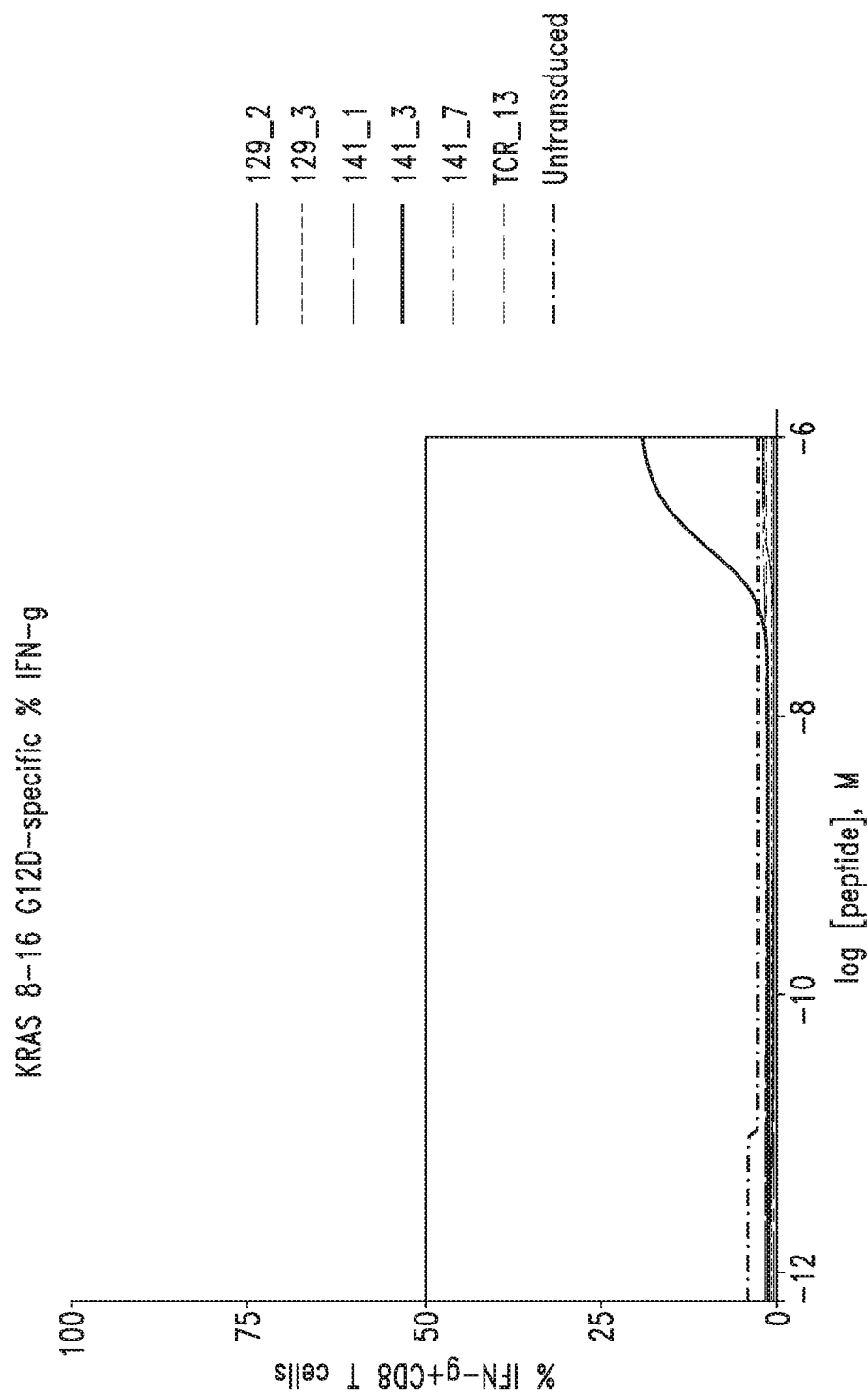
Figure 24C:
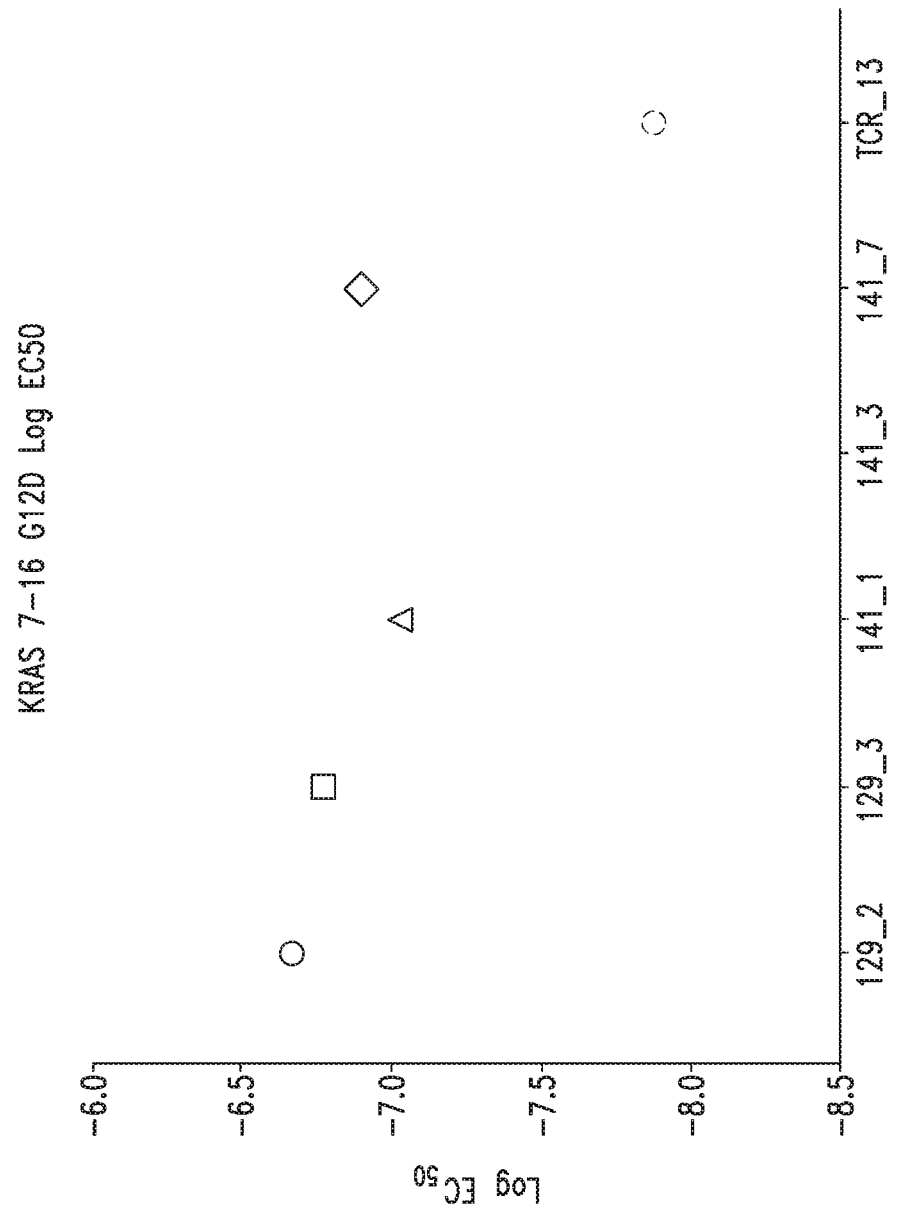
Figure 25A:
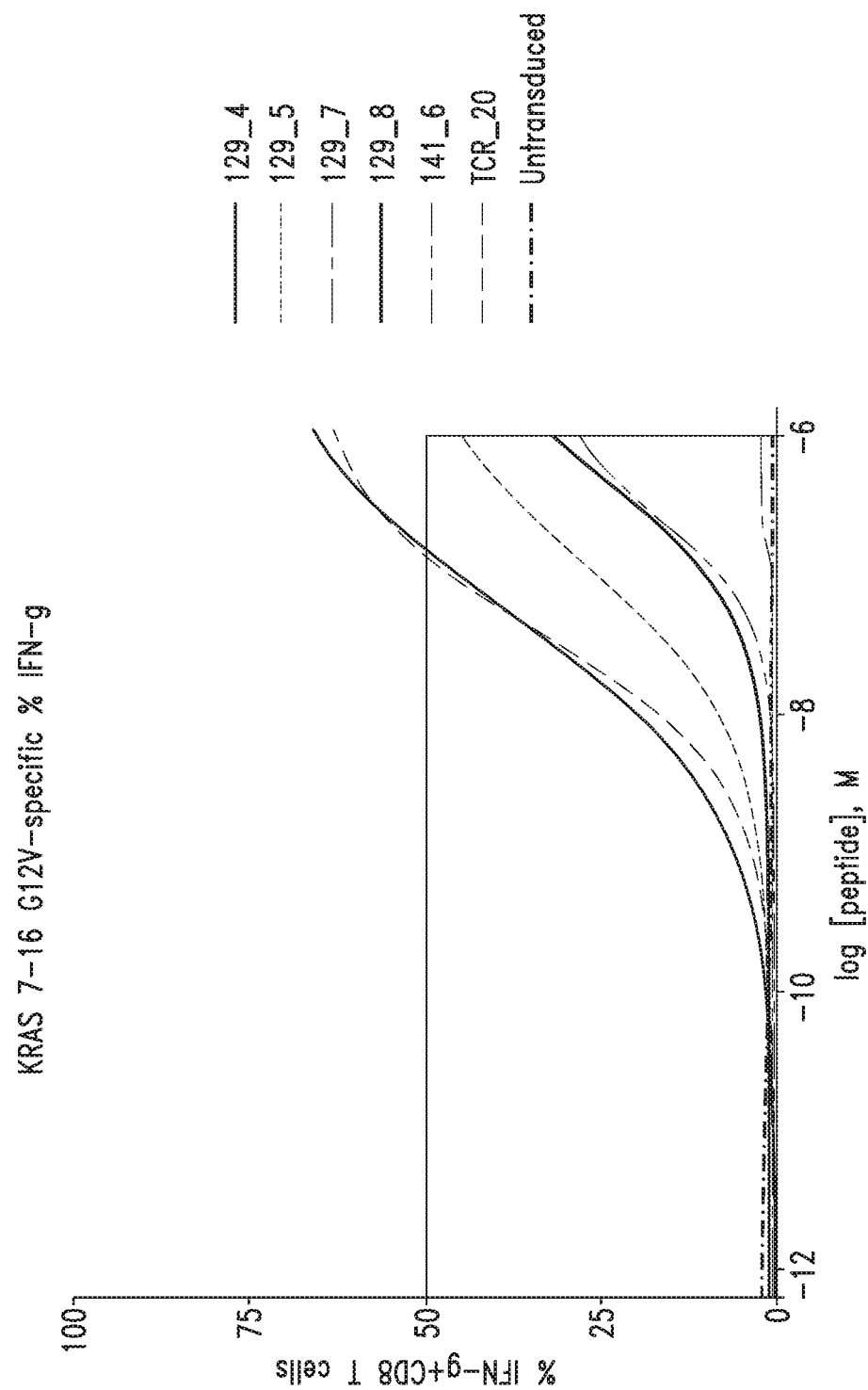
FIGS. 25A-25D show provide flow cytometry data showing log$_{10}$ EC50 for IFN-γ labelling of exemplary HLA-A11/KRAS TCR-transduced, sorted and expanded CD8$^+$ T cells after 4 h stimulation with a dose titration of G12V-mutant KRAS peptides: (A) KRAS$_{7-16}$ G12V peptide; (B) KRAS$_{8-16}$ G12V peptide; (C) KRAS$_{7-16}$ G12V log$_{10}$ EC50 of T cells transduced with the indicated TCR; (D) KRAS$_{8-16}$ G12V log$_{10}$ EC50 of T cells transduced with the indicated TCR.
Figure 25B:
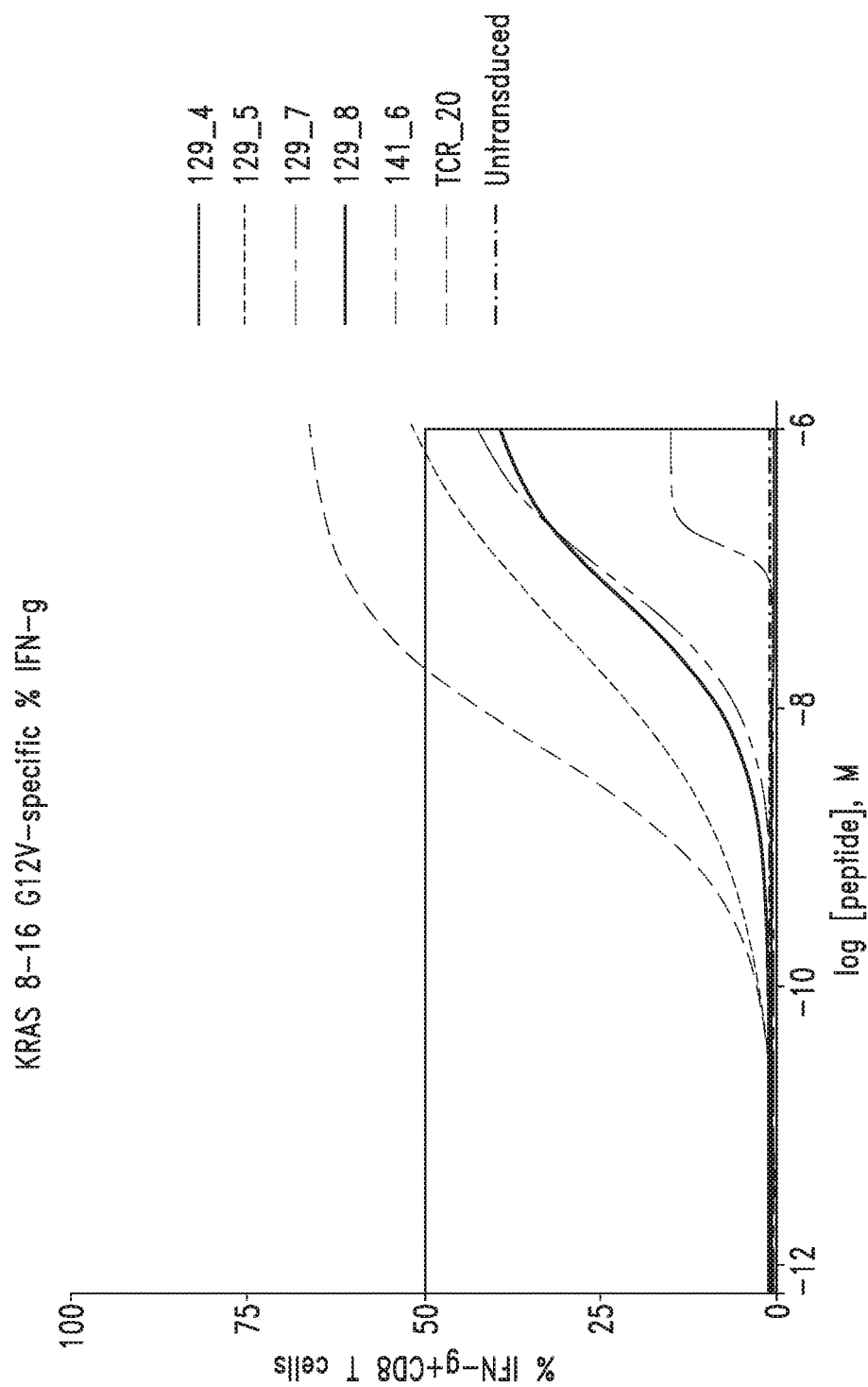
Figure 25C:
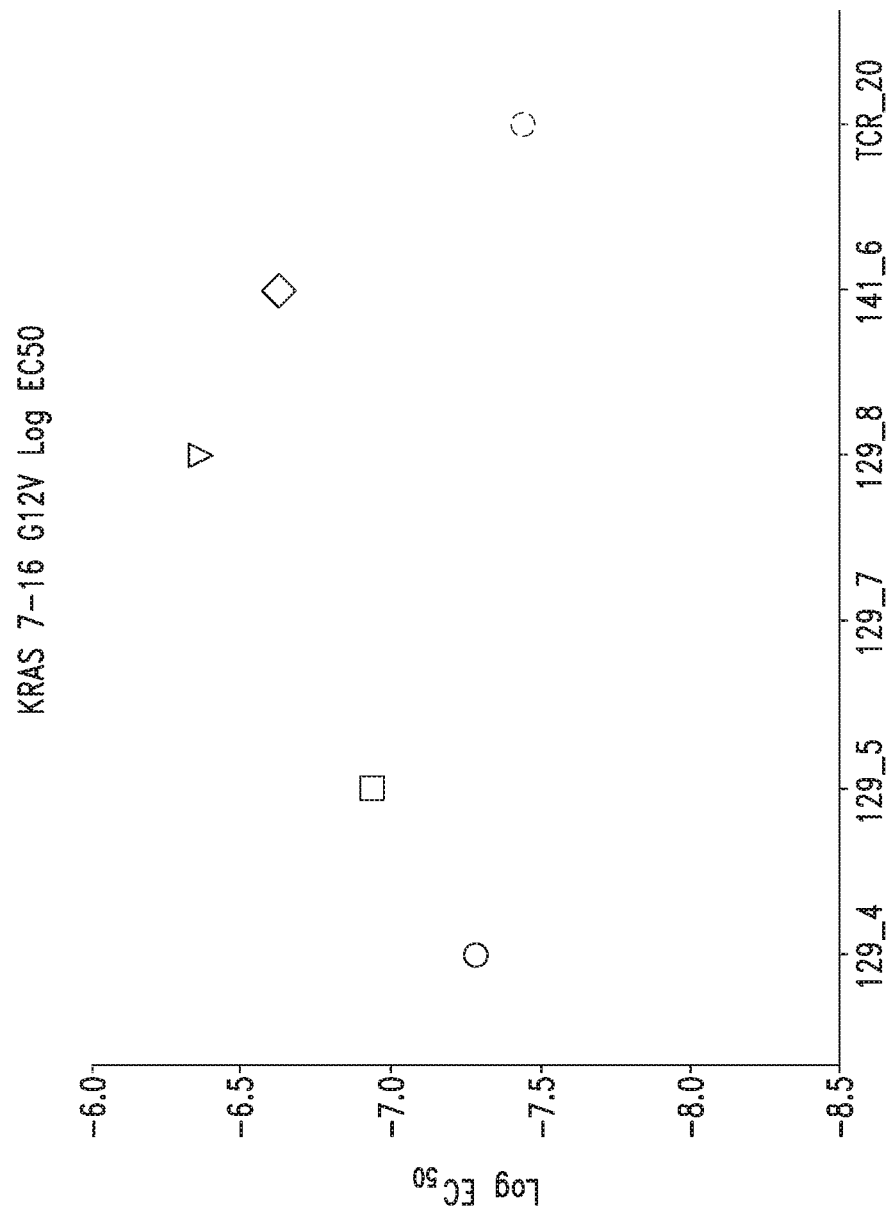
Figure 25D:
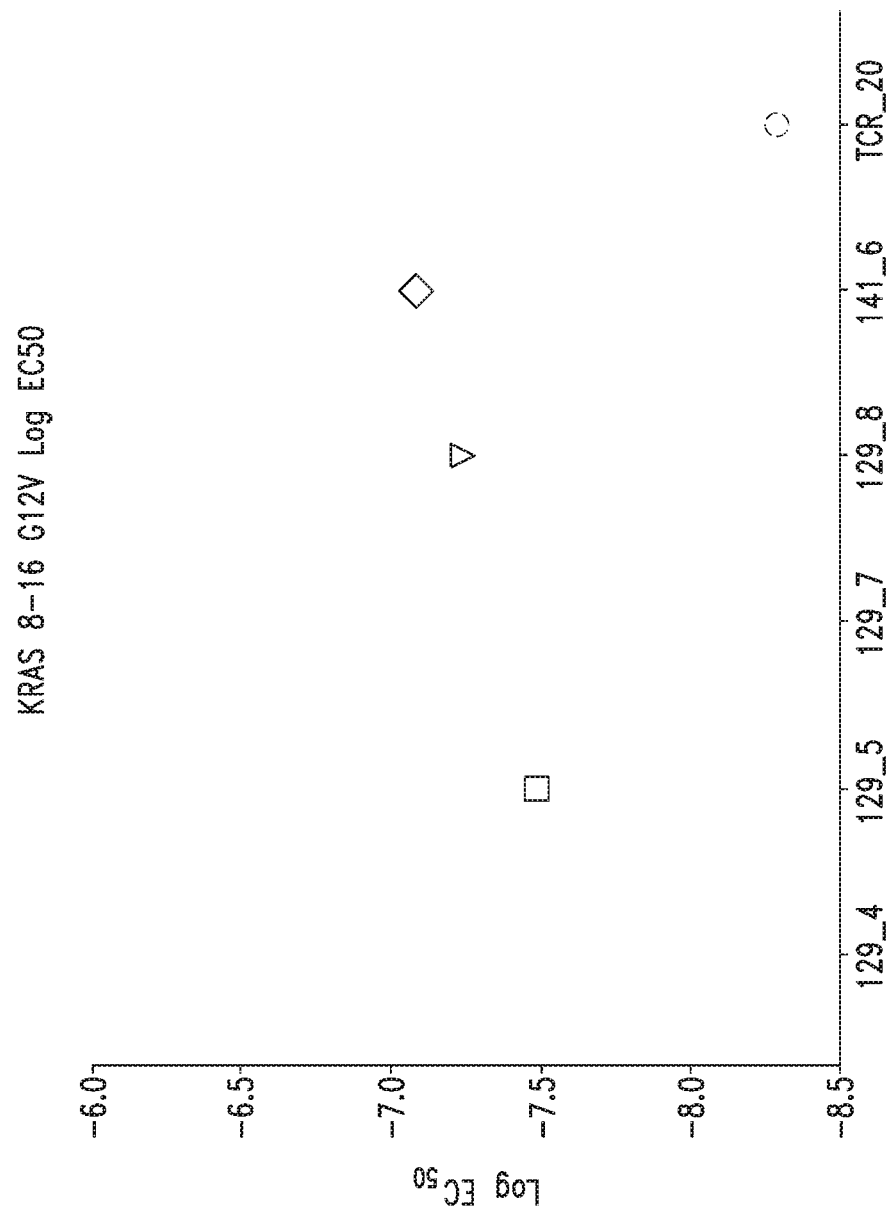
Figure 26A:
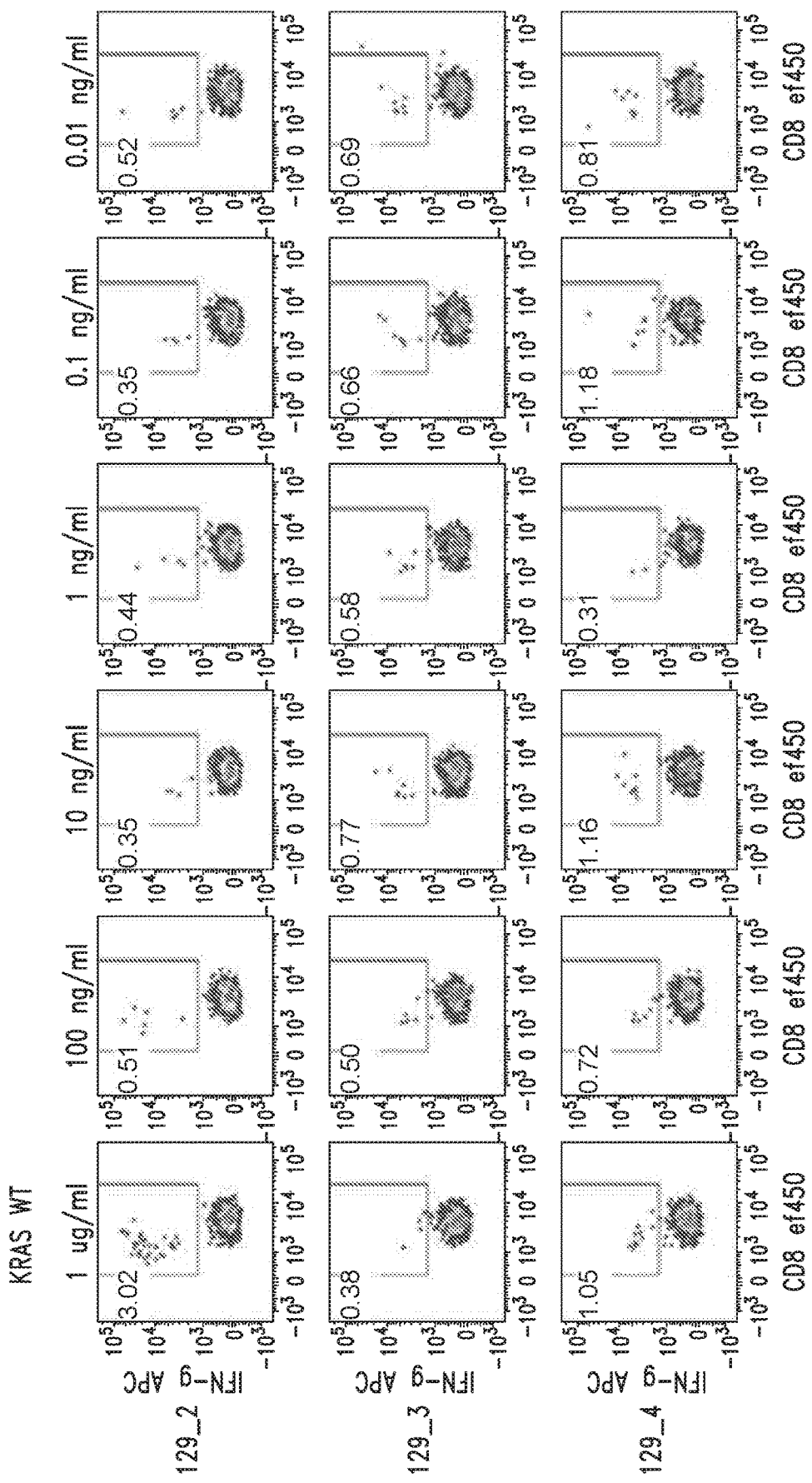
FIGS. 26A and 26B provide flow cytometry data showing IFN-γ labelling of exemplary A11/KRAS TCR-transduced, sorted and expanded CD8$^+$ T cells after 4 h stimulation with a dose titration of wild-type KRAS peptides.
Figure 26A:
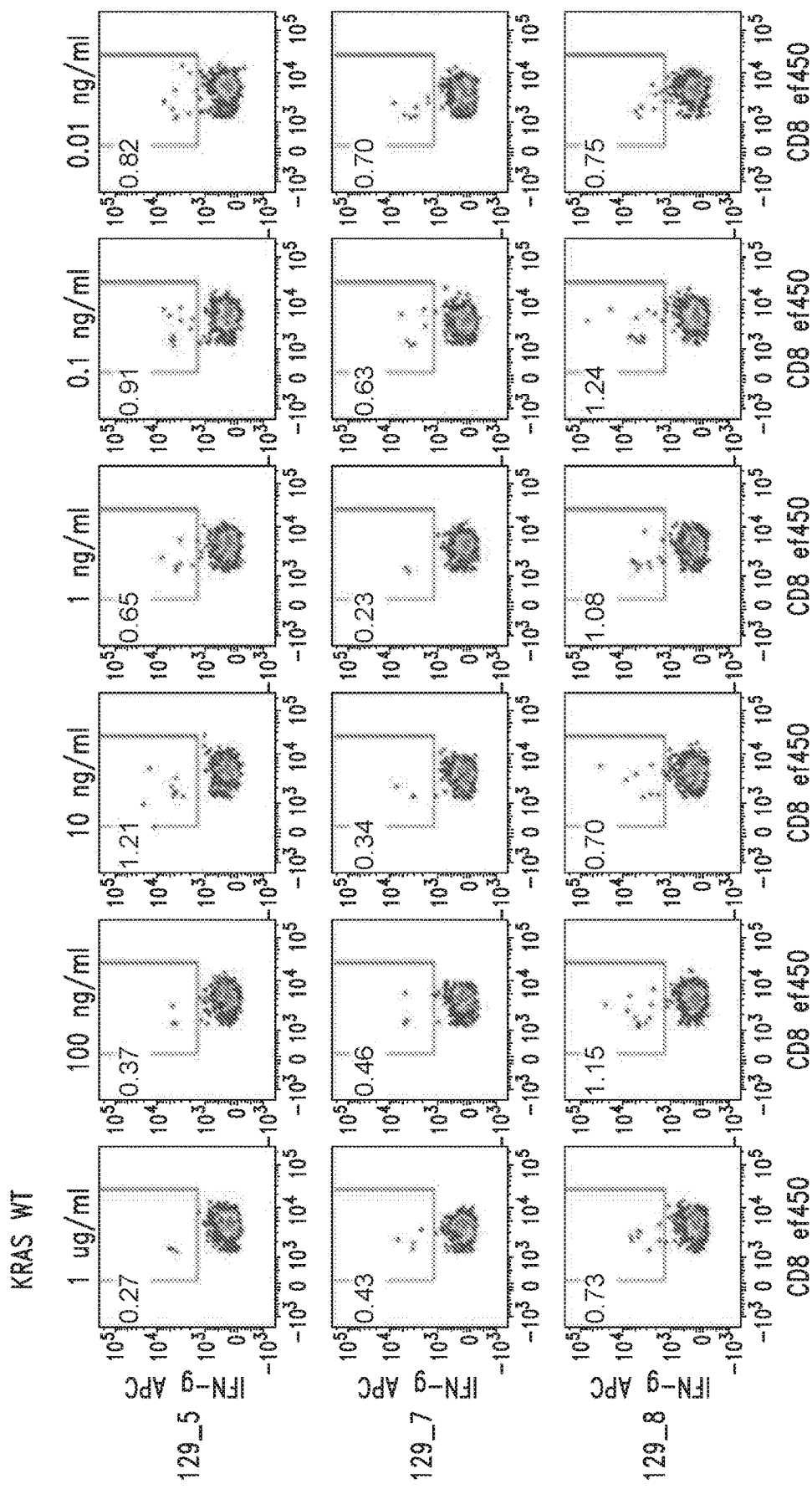
Figure 26A:
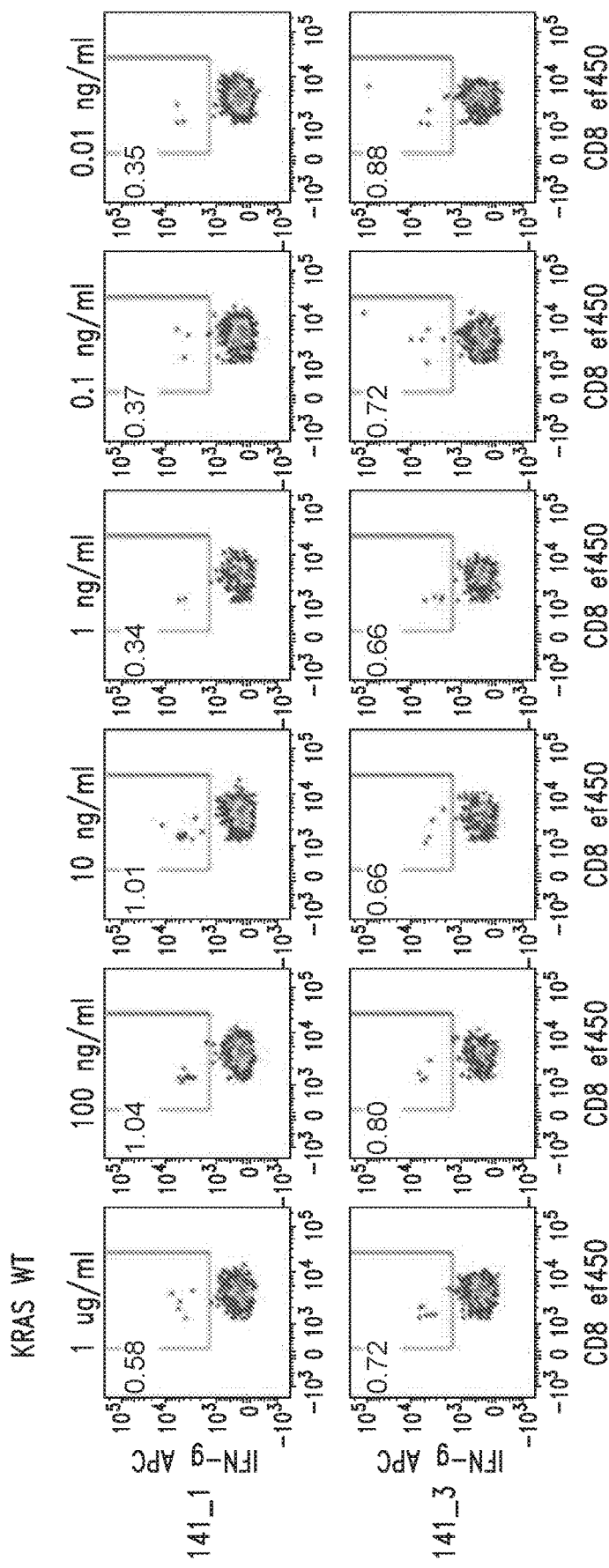
Figure 26B:
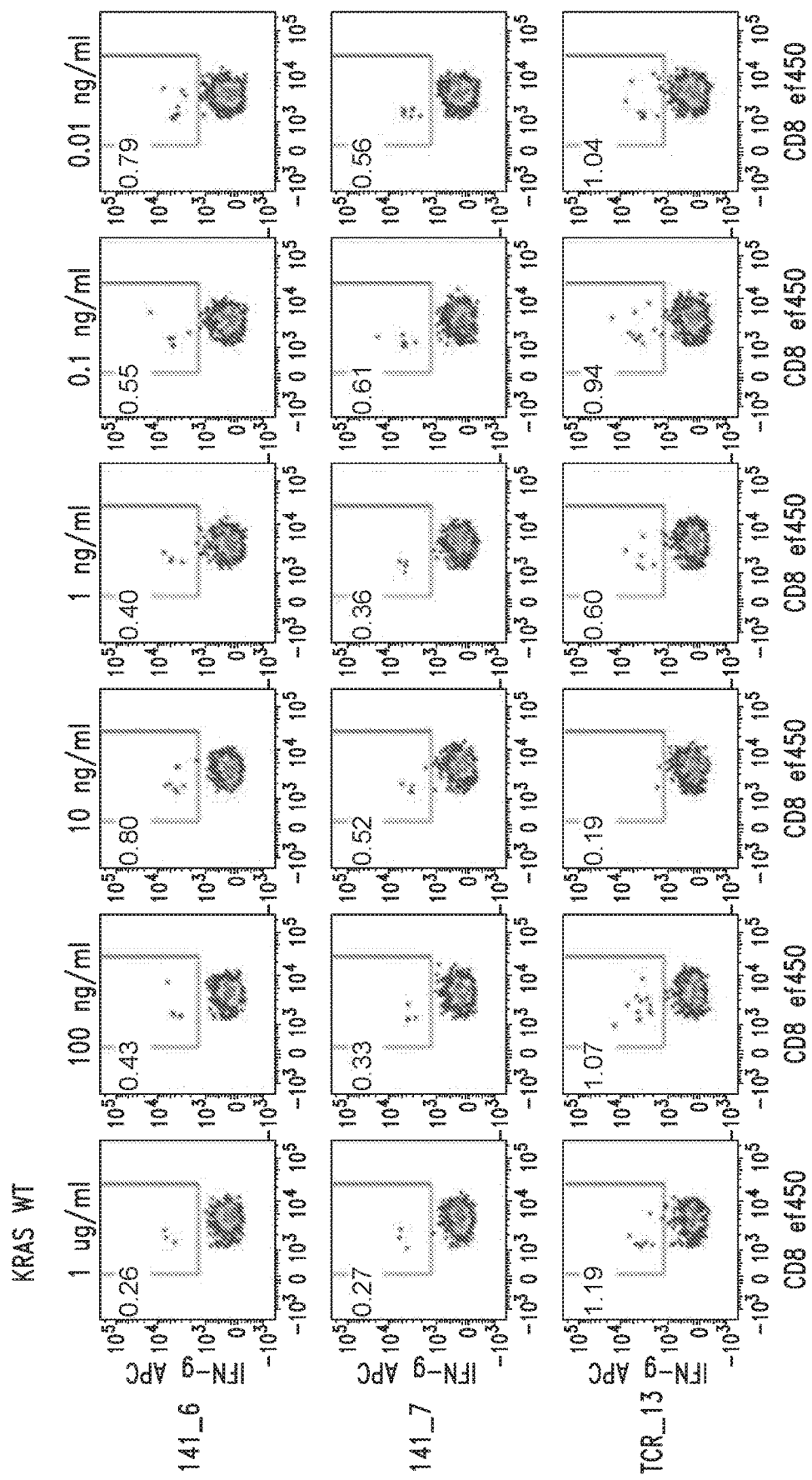
Figure 26B:
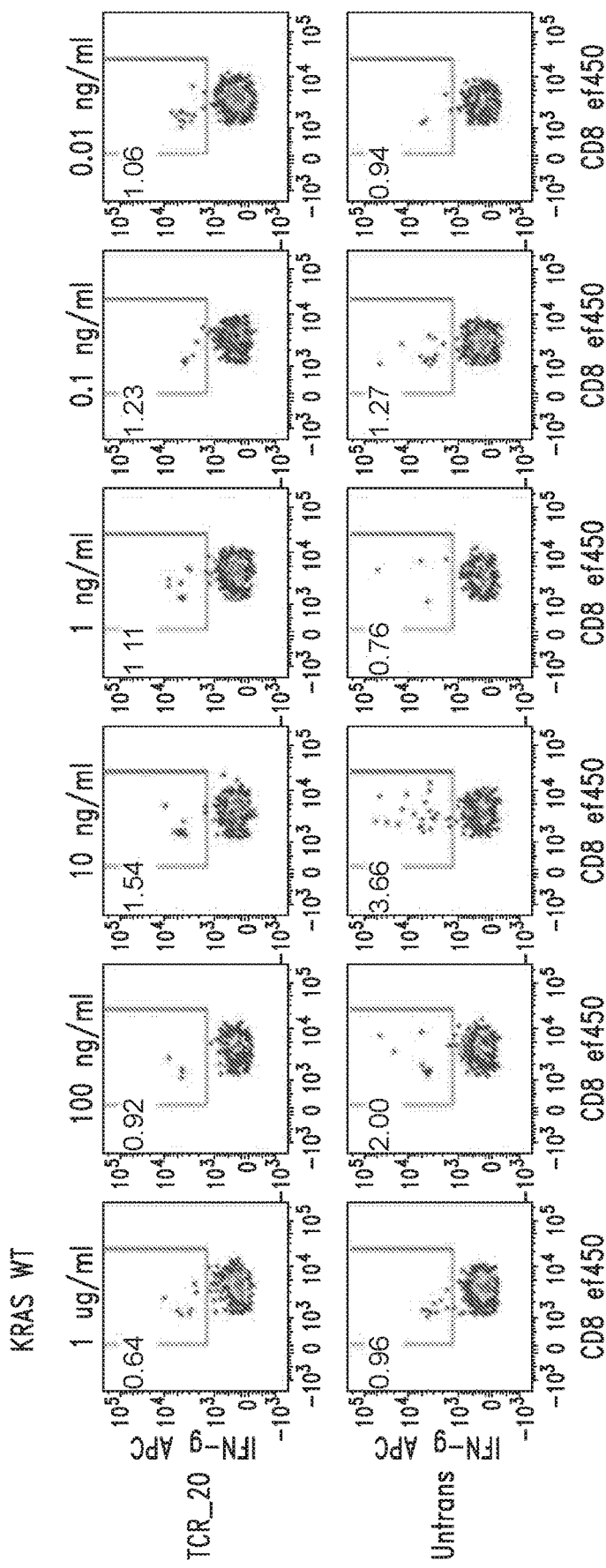

Additional A11/KRAS-specific donor T cell lines were sorted and TCRs were sequenced as described in Example 1. TCR were transduced into primary T cells, and CD137 expression to antigen was measured, as shown in FIGS. 23A and 23B. As shown in FIGS. 24A-26B, transduced T cells expressed IFN-γ in response to peptide antigen. TCRs 13 and 20 from Example 1 were included for comparison.

Figure 27A:
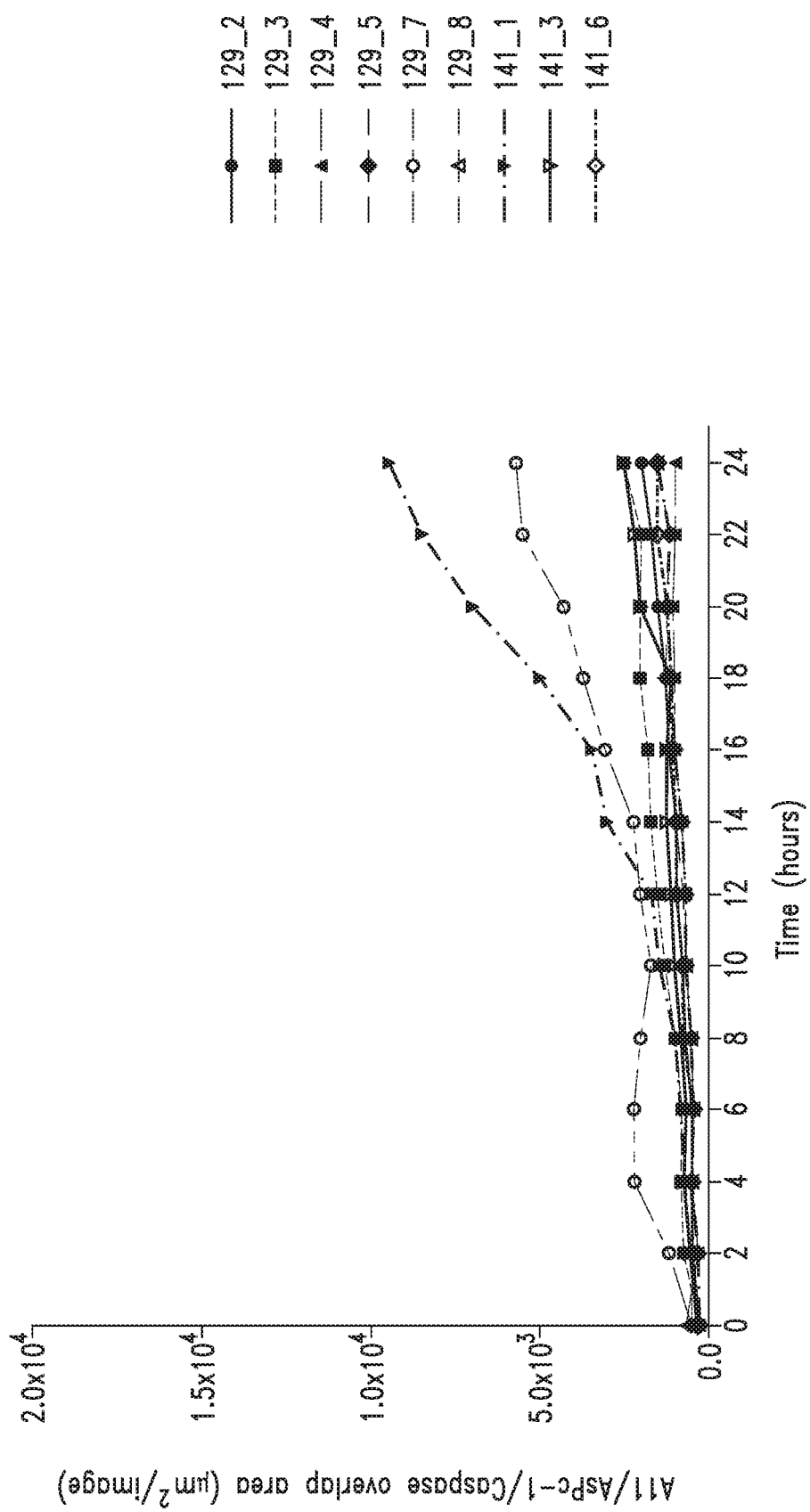
FIGS. 27A and 27B show killing of (A) HLA-A11/AsPc-1 (KRAS$_{7-16}$ G12D$^+$) and (B) HLA-A11/CFPAC-1 (KRAS$_{7/8-16}$G12V$^+$) by exemplary HLA-A11/KRAS-specific TCR-transduced, sorted and expanded CD8$^+$ T cells. Data are from IncuCyte® killing assays.
Figure 27A:
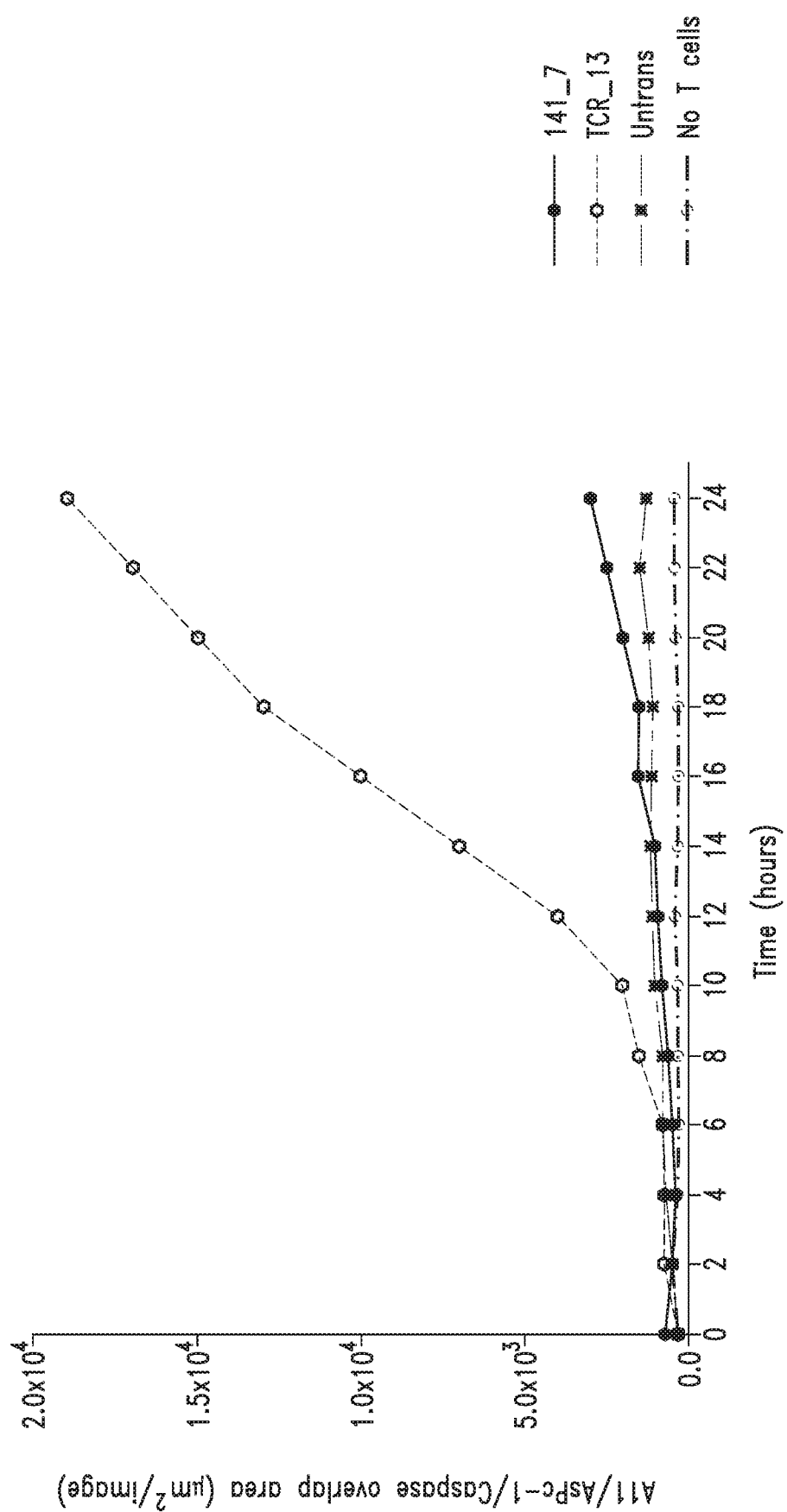
Figure 27B:
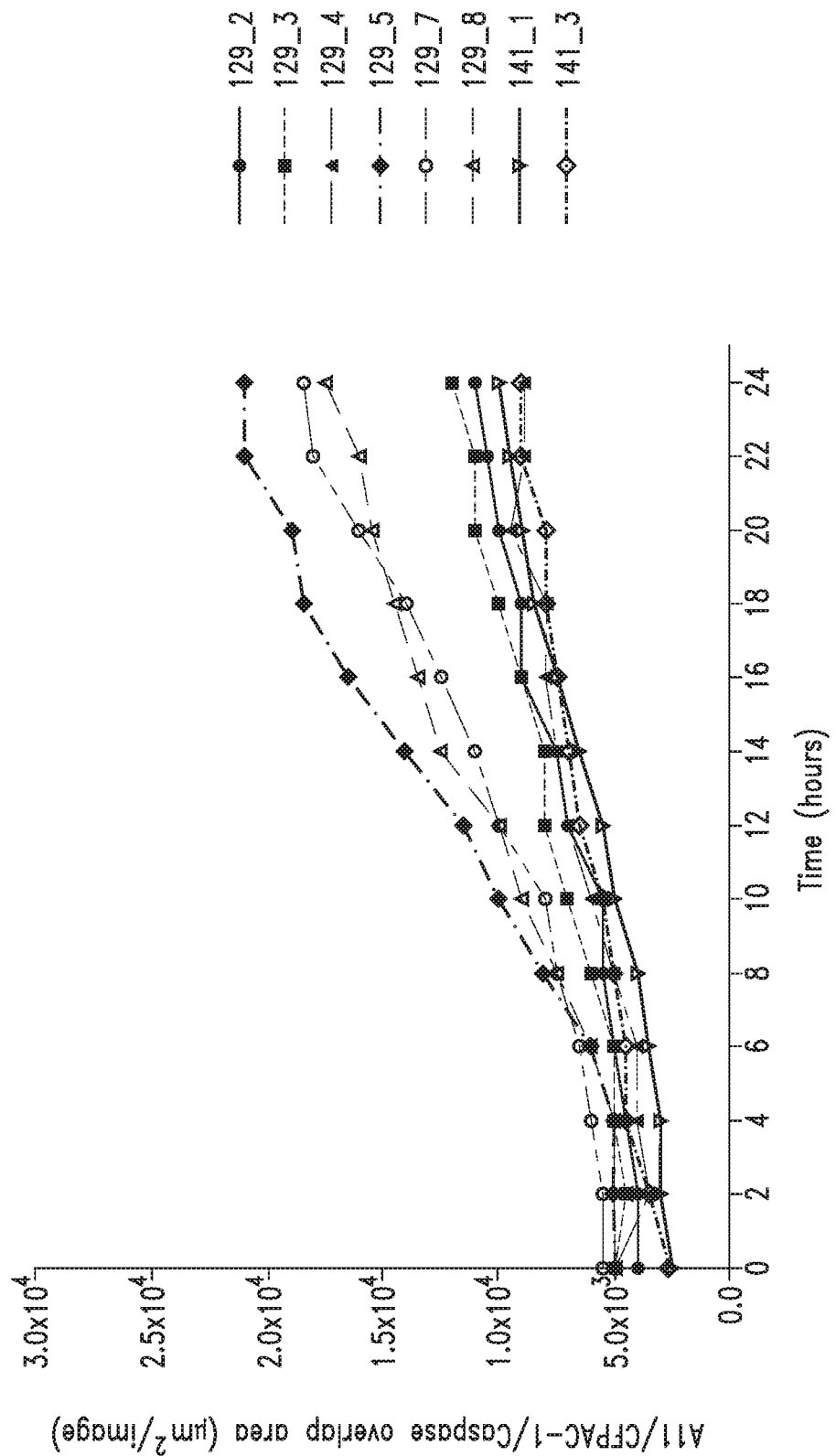
Figure 27B:
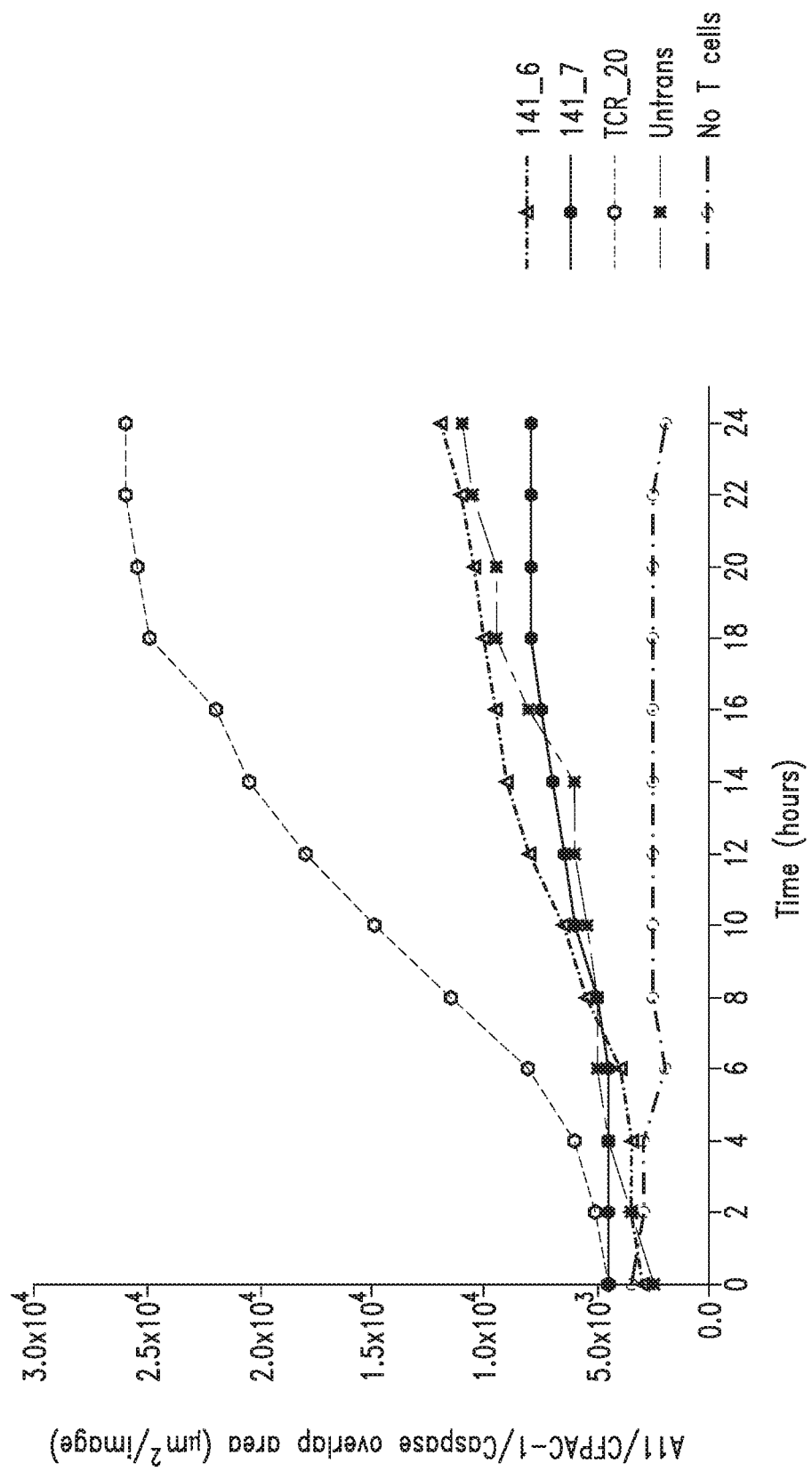

As shown in FIGS. 27A and 27B, TCR-transduced T cells effectively killed KRAS mutant peptide-expressing tumor cell lines.

Figure 29A:
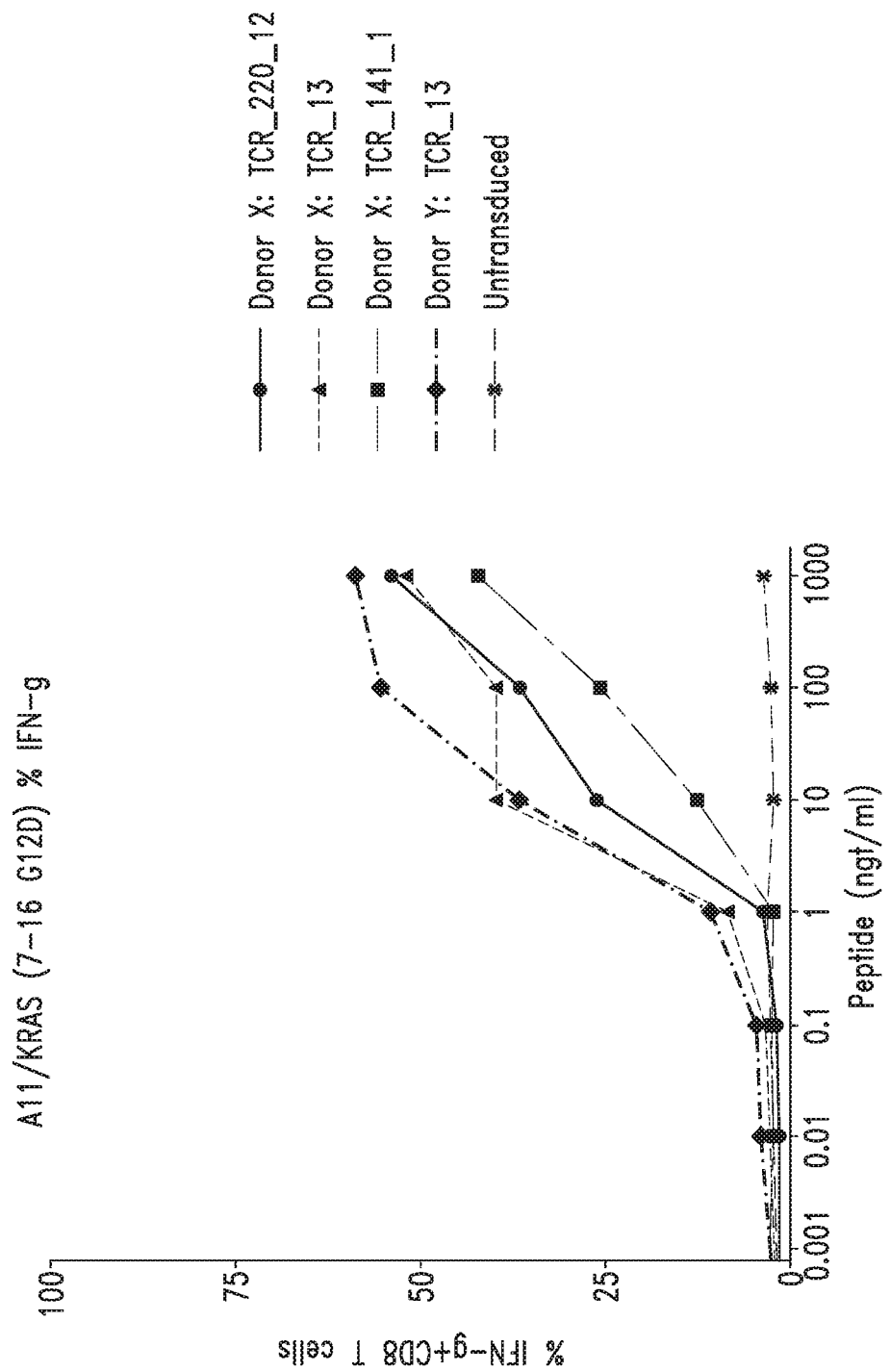
FIGS. 29A-29D provide flow cytometry data showing IFN-γ labelling of exemplary HLA-A11/KRAS TCR-transduced, sorted and expanded CD8$^+$ T cells after 4 hr stimulation with a dose titration of G12D or G12V-mutant KRAS peptides, as indicated. Data from two (2) different CD8$^+$ T cell donors shown for transduced TCRs 13 and 20. Specifically, and as indicated in the figure key, CD8+ T cells from donor X or donor Y were transduced with the indicated TCRs.
Figure 29B:
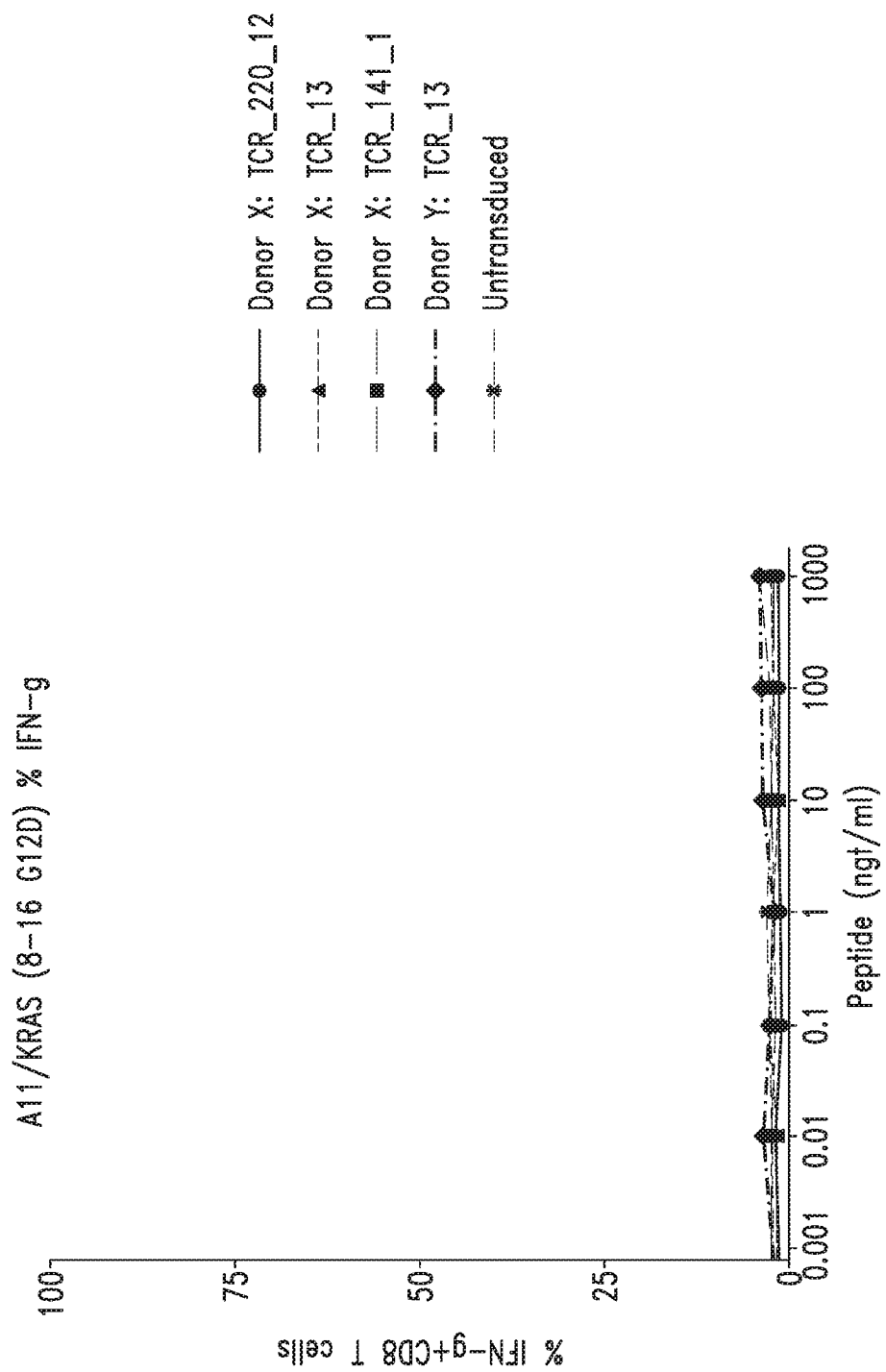
Figure 29C:
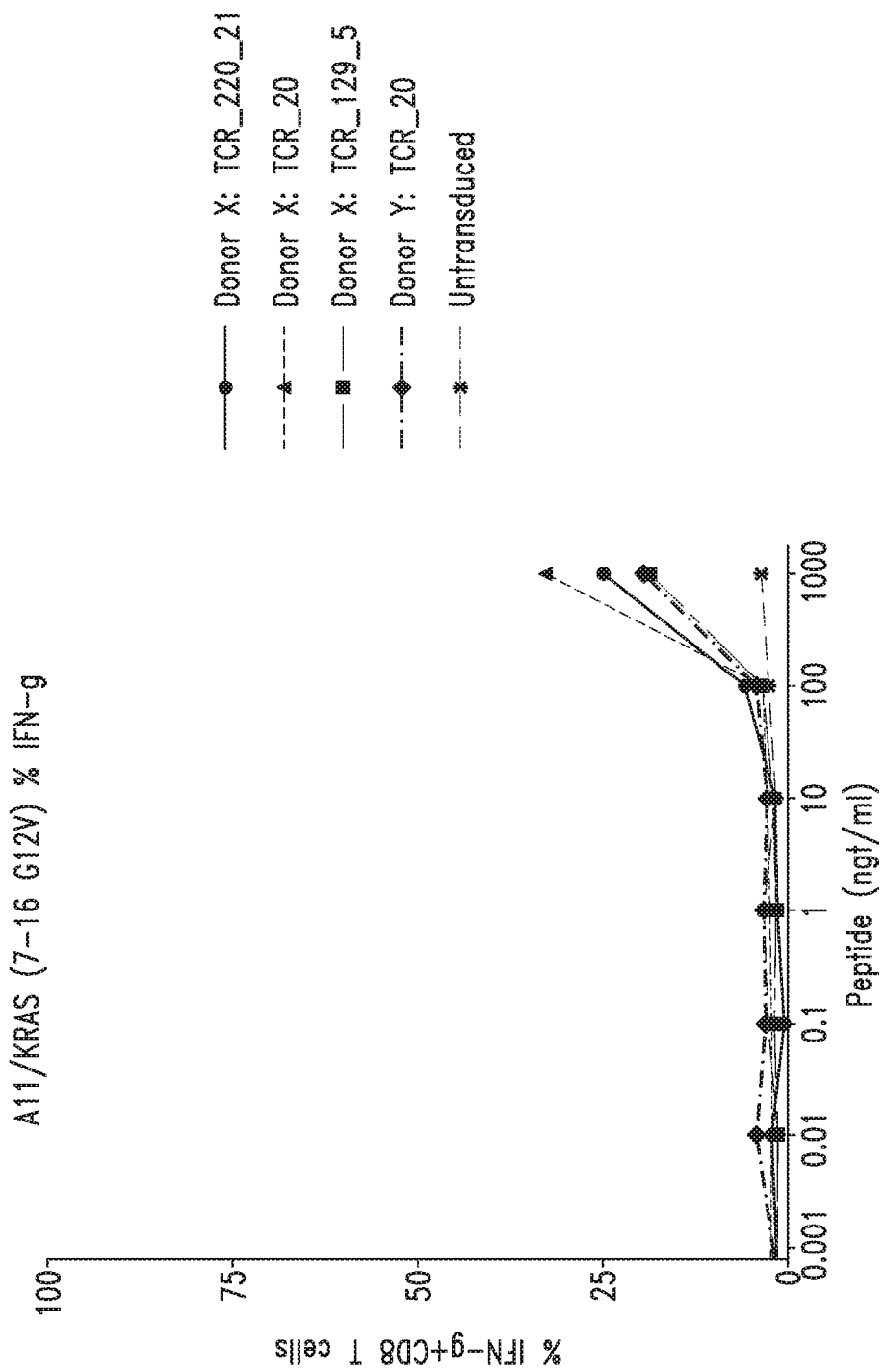
Figure 29D:
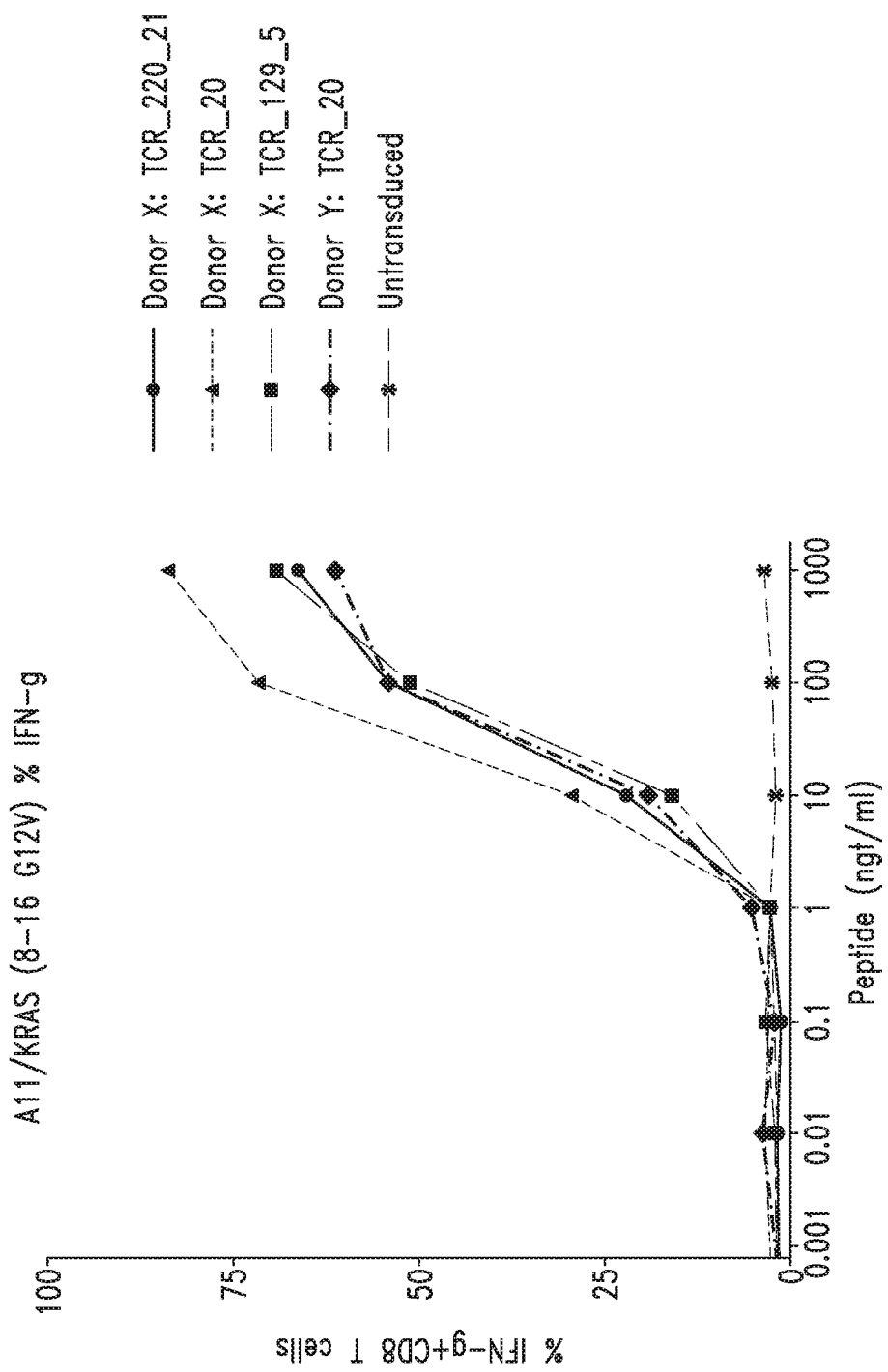
Figure 30:
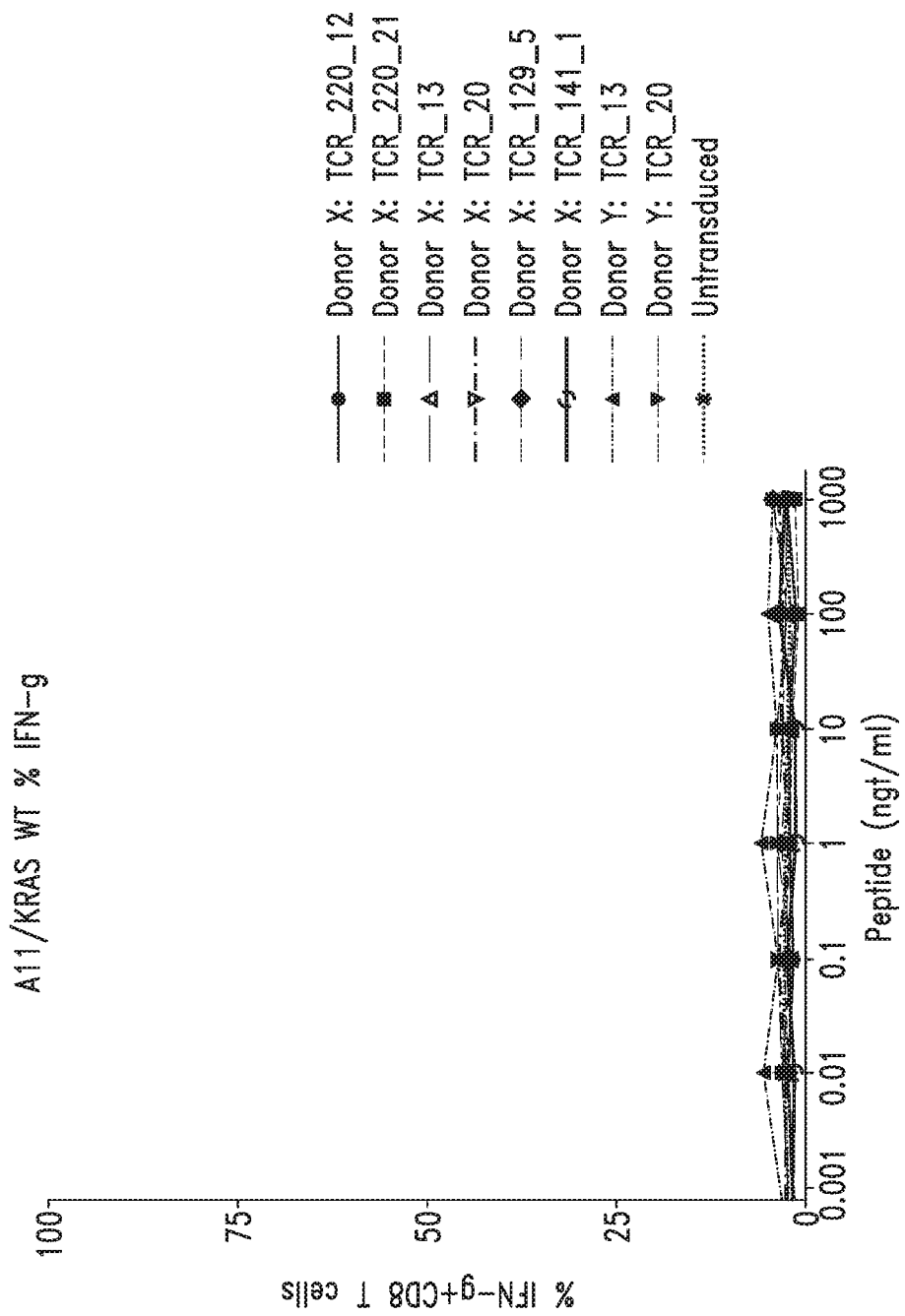
Figure 32B:
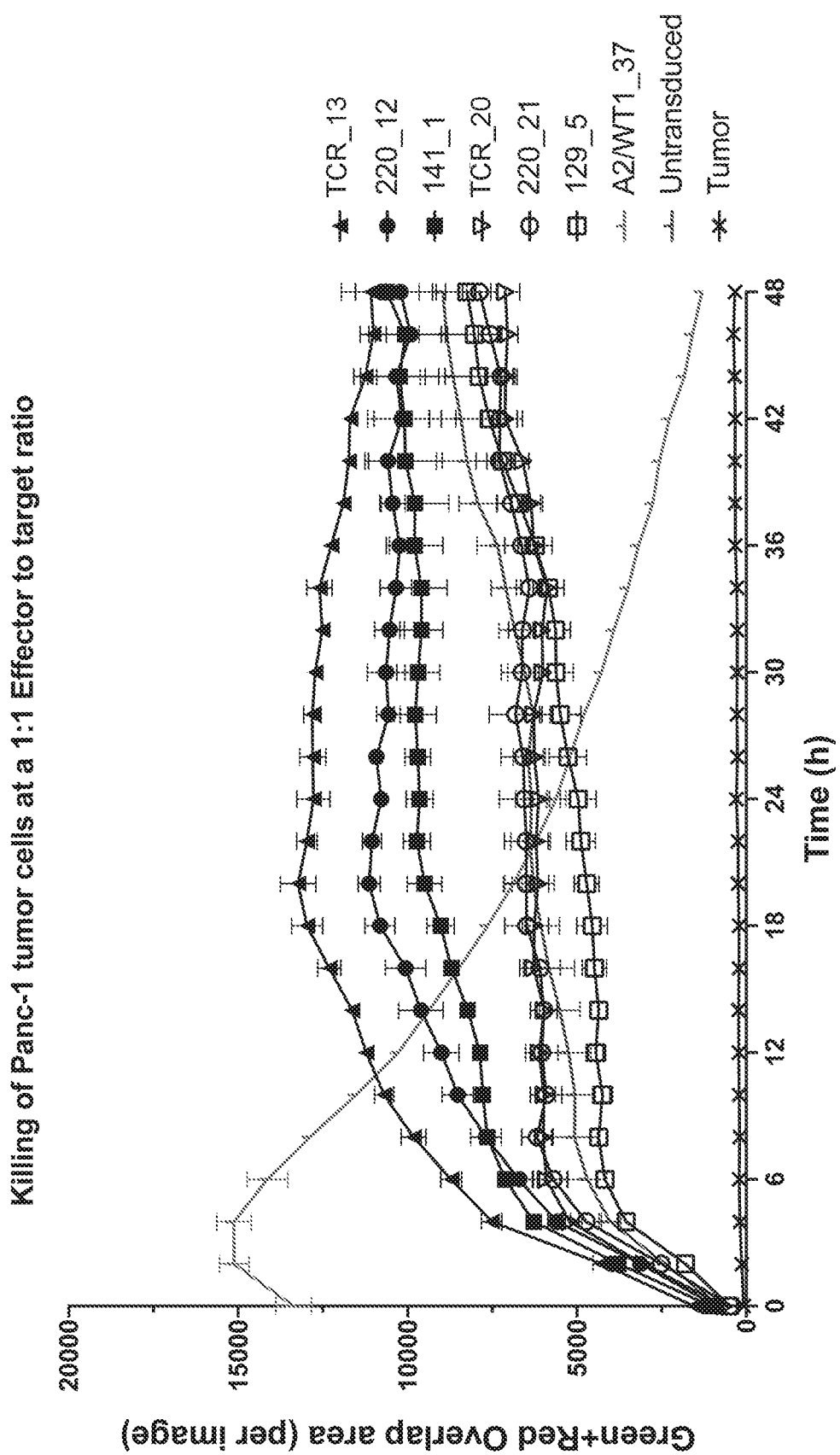
Figure 32C:
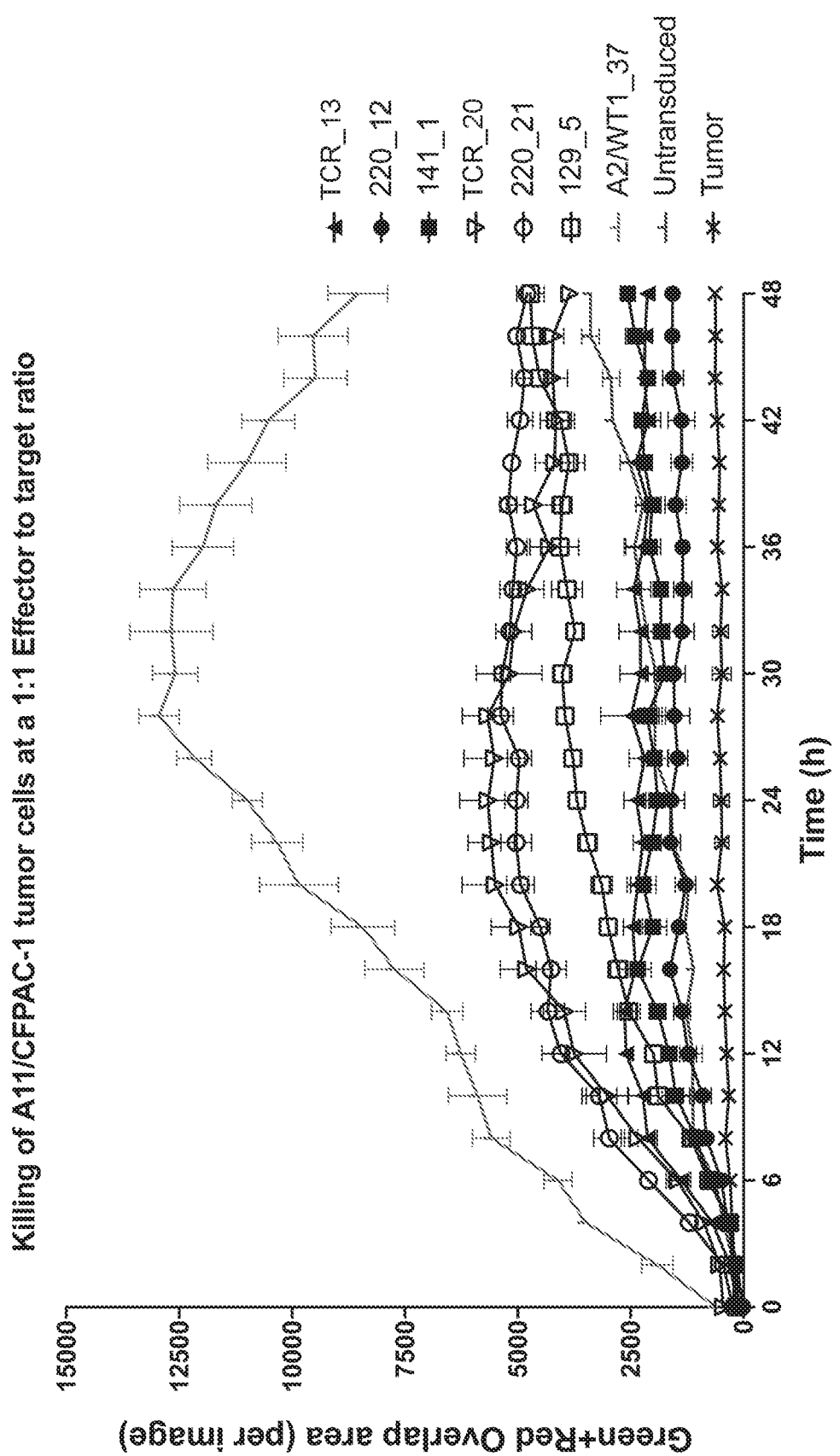
Figure 32D:
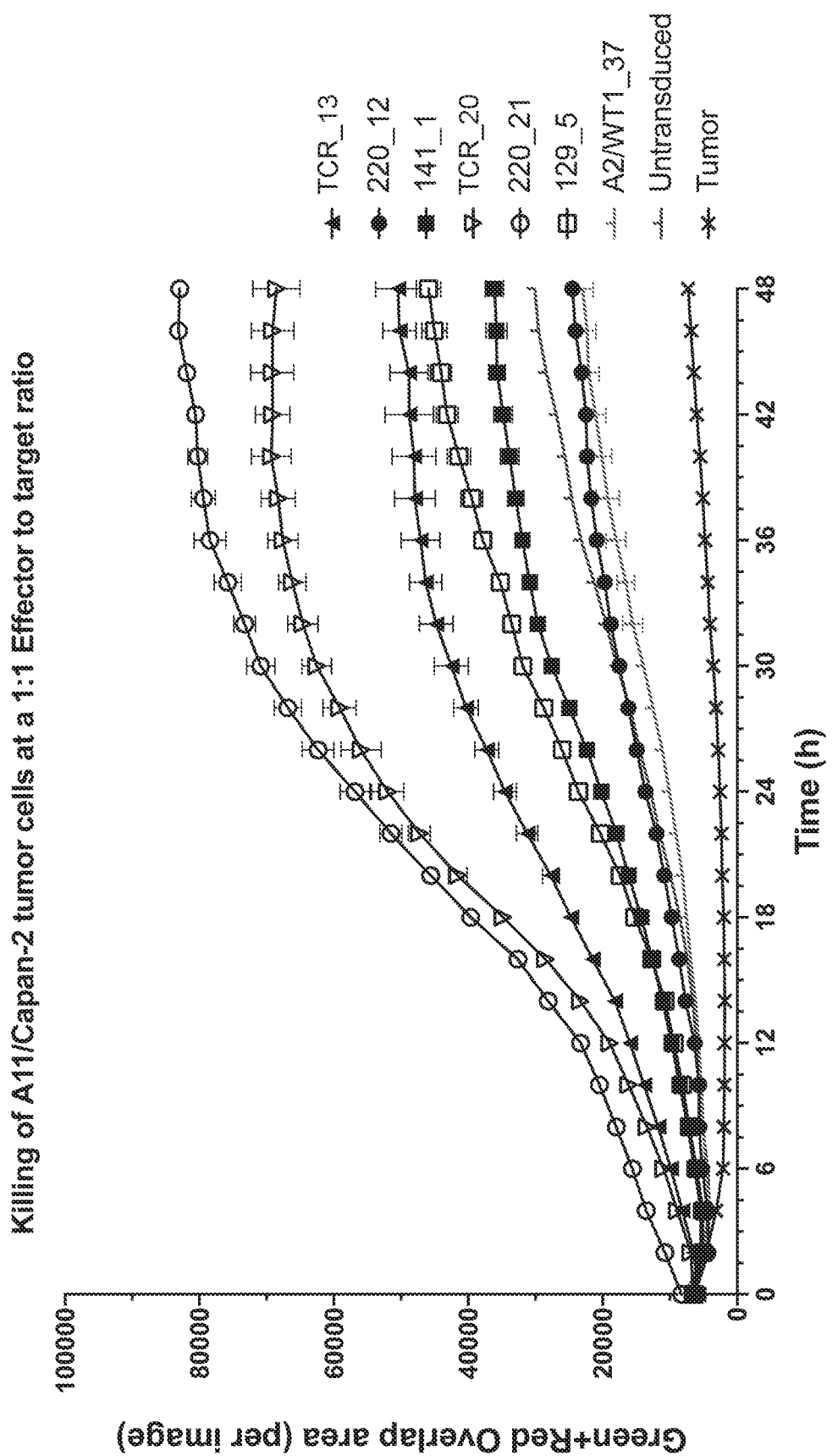

Additional A11/KRAS-specific donor T cell lines were sorted and TCRs were sequenced as described in Example 1. TCR were transduced into primary T cells, and CD137 expression in response to antigen was measured, as shown in FIGS. 28A and 28B. As shown in FIG. 29A, T cells transduced with these TCR specifically produce IFN-γ in response to mutant KRAS peptides. All/KRAS-specific TCRs from Examples 1 and 4 were tested for killing activity against tumor cell lines. As shown in FIGS. 32A-32D, T cells transduced with these TCR had killing activity against multiple tumor cell lines.

The various embodiments described above can be combined to provide further embodiments. All of the U.S. patents, U.S. patent application publications, U.S. patent applications, foreign patents, foreign patent applications and non-patent publications referred to in this specification and/or listed in the Application Data Sheet, including U.S. Provisional Application No. 62/808,248, filed Feb. 20, 2019, are incorporated herein by reference, in their entirety. Aspects of the embodiments can be modified, if necessary to employ concepts of the various patents, applications and publications to provide yet further embodiments.

These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

SEQUENCE LISTING (693 sequences)

SEQ ID NO: 1 - protein, 189 aa, Artificial Sequence [sequence omitted]

SEQ ID NO: 2 - protein, 10 aa, Artificial Sequence
  Synthetic sequence wt KRAS 7-16 G12V
VVVGAVGVGK

SEQ ID NO: 3 - protein, 9 aa, Artificial Sequence
  Synthetic sequence wt KRAS 8-16 G12V
VVGAVGVGK

SEQ ID NO: 4 - protein, 9 aa, Artificial Sequence
  Synthetic sequence KRAS 7-16 G12D
VVGADGVGK

SEQ ID NO: 5 - protein, 10 aa, Artificial Sequence
  Synthetic sequence KRAS 8-16 G12D
VVVGADGVGK

SEQ ID NO: 6 - protein, 189 aa, Artificial Sequence
  Synthetic sequence NRAS full (UniProt: P01111)
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 7 - protein, 10 aa, Artificial Sequence
  Synthetic sequence NRAS G12D (8-16)
VVVGADGVGK

SEQ ID NO: 8 - protein, 10 aa, Artificial Sequence
  Synthetic sequence NRAS G12V (8-16)
VVVGAVGVGK

SEQ ID NO: 9 - protein, 16 aa, Artificial Sequence
  Synthetic sequence TCR17_CDR3b
CASSLGAGQHNSPLHF

SEQ ID NO: 10 - protein, 17 aa, Artificial Sequence
  Synthetic sequence TCR17_CDR3a
CALSEVHASGGSYIPTF

SEQ ID NO: 11 - protein, 15 aa, Artificial Sequence
  Synthetic sequence TCR14_CDR3b
CASTHGRDSTDTQYF

SEQ ID NO: 12 - protein, 14 aa, Artificial Sequence
  Synthetic sequence TCR14_CDR3a
CATDEGGGADGLTF

SEQ ID NO: 13 - protein, 14 aa, Artificial Sequence
  Synthetic sequence TCR18_CDR3b
CASSVTWGPYEQYF

SEQ ID NO: 14 - protein, 14 aa, Artificial Sequence
  Synthetic sequence TCR18_CDR3a (1)
CATDEGGGADGLTF

SEQ ID NO: 15 - protein, 15 aa, Artificial Sequence
  Synthetic sequence TCR18_CDR3a (2)
CAESPNSGGYQKVTF

SEQ ID NO: 16 - protein, 13 aa, Artificial Sequence
  Synthetic sequence consensus CDR3b (TCR 13/22)
  VARIANT 5: Xaa = Glu or Gln
CASSXGLYNEQFF

SEQ ID NO: 17 - protein, 14 aa, Artificial Sequence
  Synthetic sequence consensus CDR3a (TCR 13/22)
  VARIANT 6: Xaa = Gly or Ser
CAMSAXAAGNKLTF

SEQ ID NO: 18 - protein, 13 aa, Artificial Sequence
  Synthetic sequence TCR13_CDR3b
CASSEGLYNEQFF

SEQ ID NO: 19 - protein, 14 aa, Artificial Sequence
  Synthetic sequence TCR13_CDR3a
CAMSASAAGNKLTF

SEQ ID NO: 20 - protein, 13 aa, Artificial Sequence
  Synthetic sequence TCR22_CDR3b
CASSQGLYNEQFF

SEQ ID NO: 21 - protein, 14 aa, Artificial Sequence
  Synthetic sequence TCR22_CDR3a
CAMSAGAAGNKLTF

SEQ ID NO: 22 - protein, 15 aa, Artificial Sequence
  Synthetic sequence TCR19_CDR3b
CASSPTGGGMLGQYF

SEQ ID NO: 23 - protein, 12 aa, Artificial Sequence
  Synthetic sequence TCR19_CDR3a
CAASANNNDMRF

SEQ ID NO: 24 - protein, 14 aa, Artificial Sequence
  Synthetic sequence TCR16_CDR3b
CASSRLGPYNEQFF

SEQ ID NO: 25 - protein, 11 aa, Artificial Sequence
  Synthetic sequence TCR16_CDR3a
CVLNRDDKIIF

SEQ ID NO: 26 - protein, 17 aa, Artificial Sequence
  Synthetic sequence TCR20_CDR3b
CASSPTFPAGDRDTQYF

SEQ ID NO: 27 - protein, 14 aa, Artificial Sequence
  Synthetic sequence TCR20_CDR3a
CIVRLNSGNTPLVF

SEQ ID NO: 28 - protein, 13 aa, Artificial Sequence
  Synthetic sequence TCR21_CDR3b
CASSVGLYNEQFF

SEQ ID NO: 29 - protein, 14 aa, Artificial Sequence
  Synthetic sequence TCR21_CDR3a
CAMSGGNAGNMLTF

SEQ ID NO: 30 - protein, 17 aa, Artificial Sequence
  Synthetic sequence TCR24_CDR3b
CASSPPGWELAKNIQYF

SEQ ID NO: 31 - protein, 12 aa, Artificial Sequence
  Synthetic sequence TCR24_CDR3a
CAGGDSSYKLIF

SEQ ID NO: 32 - protein, 14 aa, Artificial Sequence
  Synthetic sequence TCR23_CDR3b
CASSEYVGAHEQYF

SEQ ID NO: 33 - protein, 17 aa, Artificial Sequence
  Synthetic sequence TCR23_CDR3a
CAGVREAGGTSYGKLTF

SEQ ID NO: 34 - protein, 14 aa, Artificial Sequence
  Synthetic sequence TCR15_CDR3b
CAWTLTGFGQPQHF

SEQ ID NO: 35 - protein, 12 aa, Artificial Sequence
  Synthetic sequence TCR15_CDR3a
CAVNARGNMLTF

SEQ ID NO: 36 - protein, 134 aa, Artificial Sequence
  Synthetic sequence TCR17_Vb  (with leader sequence)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLGAGQHNSPLHFGNGTRLTVT

SEQ ID NO: 37 - protein, 138 aa, Artificial Sequence
  Synthetic sequence TCR17_Va (with leader sequence)
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVHASGGSYIPTFGRGTSLIVHP

SEQ ID NO: 38 - protein, 133 aa, Artificial Sequence
  Synthetic sequence TCR14_Vb  (with leader sequence)
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASTHGRDSTDTQYFGPGTRLTVL

SEQ ID NO: 39 - protein, 132 aa, Artificial Sequence
  Synthetic sequence TCR14_Va (with leader sequence)
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDEGGGADGLTFGKGTHLIIQP

SEQ ID NO: 40 - protein, 132 aa, Artificial Sequence
  Synthetic sequence TCR18_Vb (with leader sequence)
MGFRLLCCVAFCLLGAGPVDSGVTQTPKHLITATGQRVTLRCSPRSGDLSVYWYQQSLDQGLQFLIQYYNGEERAKGNILERFSAQQFPDLHSELNLSSLELGDSALYFCASSVTWGPYEQYFGPGTRLTVT

SEQ ID NO: 41 - protein, 132 aa, Artificial Sequence; identical to SEQ ID NO: 39
  Synthetic sequence TCR18_Va (with leader sequence)

SEQ ID NO: 42 - protein, 131 aa, Artificial Sequence
  Synthetic sequence TCR13_Vb (with leader sequence)
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSEGLYNEQFFGPGTRLTVL

SEQ ID NO: 43 - protein, 134 aa, Artificial Sequence
  Synthetic sequence TCR13_Va (with leader sequence)
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSASAAGNKLTFGGGTRVLVKP

SEQ ID NO: 44 - skipped

SEQ ID NO: 45 - protein, 131 aa, Artificial Sequence
  Synthetic sequence TCR22_Vb   (with leader sequence)
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSQGLYNEQFFGPGTRLTVL

SEQ ID NO: 46 - protein, 134 aa, Artificial Sequence
  Synthetic sequence TCR22_Va (with leader sequence)
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSAGAAGNKLTFGGGTRVLVKP

SEQ ID NO: 47 - protein, 134 aa, Artificial Sequence
  Synthetic sequence TCR19_Vb  (with leader sequence)
MGSWTLCCVSLCILVAKHTDAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSPTGGGMLGQYFGPGTRLTVL

SEQ ID NO: 48 - protein, 137 aa, Artificial Sequence
  Synthetic sequence TCR19_Va (with leader sequence)
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASANNNDMRFGAGTRLTVKP

SEQ ID NO: 49 - protein, 133 aa, Artificial Sequence
  Synthetic sequence TCR16_Vb (with leader sequence)
MGSWTLCCVSLCILVAKHTDAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSRLGPYNEQFFGPGTRLTVL

SEQ ID NO: 50 - protein, 129 aa, Artificial Sequence
  Synthetic sequence TCR16_Va (with leader sequence)
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCVLNRDDKIIFGKGTRLHILP

SEQ ID NO: 51 - protein, 137 aa, Artificial Sequence
  Synthetic sequence TCR20_Vb (with leader sequence)
MGTRLLCWAALCLLGAELLTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSPTFPAGDRDTQYFGPGTRLTVL

SEQ ID NO: 52 - protein, 128 aa, Artificial Sequence
  Synthetic sequence TCR20_Va (with leader sequence)
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRLNSGNTPLVFGKGTRLSVIA

SEQ ID NO: 53 - protein, 131 aa, Artificial Sequence
  Synthetic sequence TCR21_Vb (with leader sequence)
MTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSVGLYNEQFFGPGTRLTVL

SEQ ID NO: 54 - protein, 134 aa, Artificial Sequence
  Synthetic sequence TCR21_Va (with leader sequence)
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSGGNAGNMLTFGGGTRLMVKP

SEQ ID NO: 55 - protein, 136 aa, Artificial Sequence
  Synthetic sequence TCR24_Vb (with leader sequence)
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSPPGWELAKNIQYFGAGTRLSVL

SEQ ID NO: 56 - protein, 126 aa, Artificial Sequence
  Synthetic sequence TCR24_Va (with leader sequence)
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAGGDSSYKLIFGSGTRLLVRP

SEQ ID NO: 57 - protein, 132 aa, Artificial Sequence
  Synthetic sequence TCR23_Vb (with leader sequence)
MGTRLFFYVALCLLWAGHRDAEITQSPRHKITETGRQVTLACHQTWNHNNMFWYRQDLGHGLRLIHYSYGVQDTNKGEVSDGYSVSRSNTEDLPLTLESAASSQTSVYFCASSEYVGAHEQYFGPGTRLTVT

SEQ ID NO: 58 - protein, 133 aa, Artificial Sequence
  Synthetic sequence TCR23_Va (with leader sequence)
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGVREAGGTSYGKLTFGQGTILTVHP

SEQ ID NO: 59 - protein, 131 aa, Artificial Sequence
  Synthetic sequence TCR15_Vb (with leader sequence)
MMLCSLLALLLGTFFGVRSQTIHQWPATLVQPVGSPLSLECTVEGTSNPNLYWYRQAAGRGLQLLFYSVGIGQISSEVPQNLSASRPQDRQFILSSKKLLLSDSGFYLCAWTLTGFGQPQHFGDGTRLSIL

SEQ ID NO: 60 - protein, 130 aa, Artificial Sequence
  Synthetic sequence TCR15_Va (with leader sequence)
MKSLRVLLVILWLQLSWVWSQKEVEQNSGPLSVPEGAIASLNCTYSDRGSQSFFWYRQYSGKSPELIMFIYSNGDKEDGRFTAQLNKASQYVSLLIRDSQPSDSATYLCAVNARGNMLTFGGGTRLMVKP

SEQ ID NO: 61 - protein, 115 aa, Artificial Sequence
  Synthetic sequence TCR17_Vb (leader sequence removed)
DVKVTQSSRYLVKRTGEKVFLECVQDMDHENMFWYRQDPGLGLRLIYFSYDVKMKEKGDIPEGYSVSREKKERFSLILESASTNQTSMYLCASSLGAGQHNSPLHFGNGTRLTVT

SEQ ID NO: 62 - protein, 116 aa, Artificial Sequence
  Synthetic sequence TCR17_Va (leader sequence removed)
KVTQAQTEISVVEKEDVTLDCVYETRDTTYYLFWYKQPPSGELVFLIRRNSFDEQNEISGRYSWNFQKSTSSFNFTITASQVVDSAVYFCALSEVHASGGSYIPTFGRGTSLIVHP

SEQ ID NO: 63 - protein, 114 aa, Artificial Sequence
  Synthetic sequence TCR14_Vb (leader sequence removed)
DSGVTQTPKHLITATGQRVTLRCSPRSGDLSVYWYQQSLDQGLQFLIQYYNGEERAKGNILERFSAQQFPDLHSELNLSSLELGDSALYFCASTHGRDSTDTQYFGPGTRLTVL

SEQ ID NO: 64 - protein, 112 aa, Artificial Sequence
  Synthetic sequence TCR14_Va (leader sequence removed)
SQQGEEDPQALSIQEGENATMNCSYKTSINNLQWYRQNSGRGLVHLILIRSNEREKHSGRLRVTLDTSKKSSSLLITASRAADTASYFCATDEGGGADGLTFGKGTHLIIQP

SEQ ID NO: 65 - protein, 113 aa, Artificial Sequence
  Synthetic sequence TCR18_Vb (leader sequence removed)
DSGVTQTPKHLITATGQRVTLRCSPRSGDLSVYWYQQSLDQGLQFLIQYYNGEERAKGNILERFSAQQFPDLHSELNLSSLELGDSALYFCASSVTWGPYEQYFGPGTRLTVT

SEQ ID NO: 66 - protein, 112 aa, Artificial Sequence; identical to SEQ ID NO: 64
  Synthetic sequence TCR18_Va (leader sequence removed)

SEQ ID NO: 67 - protein, 112 aa, Artificial Sequence
  Synthetic sequence TCR13_Vb (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSEGLYNEQFFGPGTRLTVL

SEQ ID NO: 68 - protein, 112 aa, Artificial Sequence
  Synthetic sequence TCR13_Va (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSASAAGNKLTFGGGTRVLVKP

SEQ ID NO: 69 - protein, 112 aa, Artificial Sequence
  Synthetic sequence TCR22_Vb (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSQGLYNEQFFGPGTRLTVL

SEQ ID NO: 70 - protein, 112 aa, Artificial Sequence
  Synthetic sequence TCR22_Va (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSAGAAGNKLTFGGGTRVLVKP

SEQ ID NO: 71 - protein, 115 aa, Artificial Sequence
  Synthetic sequence TCR19_Vb (leader sequence removed)
DAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSPTGGGMLGQYFGPGTRLTVL

SEQ ID NO: 72 - protein, 111 aa, Artificial Sequence
  Synthetic sequence TCR19_Va (leader sequence removed)
DQQVKQNSPSLSVQEGRISILNCDYTNSMFDYFLWYKKYPAEGPTFLISISSIKDKNEDGRFTVFLNKSAKHLSLHIVPSQPGDSAVYFCAASANNNDMRFGAGTRLTVKP

SEQ ID NO: 73 - protein, 114 aa, Artificial Sequence
  Synthetic sequence TCR16_Vb (leader sequence removed)
DAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSRLGPYNEQFFGPGTRLTVL

SEQ ID NO: 74 - protein, 104 aa, Artificial Sequence
  Synthetic sequence TCR16_Va (leader sequence removed)
KDQVFQPSTVASSEGAVVEIFCNHSVSNAYNFFWYLHFPGCAPRLLVKGSKPSQQGRYNMTYERFSSSLLILQVREADAAVYYCVLNRDDKIIFGKGTRLHILP

SEQ ID NO: 75 - protein, 118 aa, Artificial Sequence
  Synthetic sequence TCR20_Vb (leader sequence removed)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSPTFPAGDRDTQYFGPGTRLTVLE

SEQ ID NO: 76 - protein, 111 aa, Artificial Sequence
  Synthetic sequence TCR20_Va (leader sequence removed)
DAKTTQPPSMDCAEGRAANLPCNHSTISGNEYVYWYRQIHSQGPQYIIHGLKNNETNEMASLIITEDRKSSTLILPHATLRDTAVYYCIVRLNSGNTPLVFGKGTRLSVIA

SEQ ID NO: 77 - protein, 112 aa, Artificial Sequence
  Synthetic sequence TCR21_Vb (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSVGLYNEQFFGPGTRLTVL

SEQ ID NO: 78 - protein, 112 aa, Artificial Sequence
  Synthetic sequence TCR21_Va (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSGGNAGNMLTFGGGTRLMVKP

SEQ ID NO: 79 - protein, 117 aa, Artificial Sequence
  Synthetic sequence TCR24_Vb (leader sequence removed)
DTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSPPGWELAKNIQYFGAGTRLSVL

SEQ ID NO: 80 - protein, 109 aa, Artificial Sequence
  Synthetic sequence TCR24_Va (leader sequence removed)
GQSLEQPSEVTAVEGAIVQINCTYQTSGFYGLSWYQQHDGGAPTFLSYNALDGLEETGRFSSFLSRSDSYGYLLLQELQMKDSASYFCAGGDSSYKLIFGSGTRLLVRP

SEQ ID NO: 81 - protein, 113 aa, Artificial Sequence
  Synthetic sequence TCR23_Vb (leader sequence removed)
DAEITQSPRHKITETGRQVTLACHQTWNHNNMFWYRQDLGHGLRLIHYSYGVQDTNKGEVSDGYSVSRSNTEDLPLTLESAASSQTSVYFCASSEYVGAHEQYFGPGTRLTVT

SEQ ID NO: 82 - protein, 115 aa, Artificial Sequence
  Synthetic sequence TCR23_Va (leader sequence removed)
TQLLEQSPQFLSIQEGENLTVYCNSSSVFSSLQWYRQEPGEGPVLLVTVVTGGEVKKLKRLTFQFGDARKDSSLHITAAQPGDTGLYLCAGVREAGGTSYGKLTFGQGTILTVHP

SEQ ID NO: 83 - protein, 113 aa, Artificial Sequence
  Synthetic sequence TCR15_Vb (leader sequence removed)
SQTIHQWPATLVQPVGSPLSLECTVEGTSNPNLYWYRQAAGRGLQLLFYSVGIGQISSEVPQNLSASRPQDRQFILSSKKLLLSDSGFYLCAWTLTGFGQPQHFGDGTRLSIL

SEQ ID NO: 84 - protein, 110 aa, Artificial Sequence
  Synthetic sequence TCR15_Va (leader sequence removed)
QKEVEQNSGPLSVPEGAIASLNCTYSDRGSQSFFWYRQYSGKSPELIMFIYSNGDKEDGRFTAQLNKASQYVSLLIRDSQPSDSATYLCAVNARGNMLTFGGGTRLMVKP

SEQ ID NO: 85 - protein, 140 aa, Artificial Sequence
  Synthetic sequence human TRAC gene product (Uniprot P01848)
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 86 - protein, 140 aa, Artificial Sequence
  Synthetic sequence human TRAC gene product (Uniprot P01848) with T47C mod
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 87 - protein, 176 aa, Artificial Sequence
  Synthetic sequence human TRBC1 gene product (Uniprot P01848)
DLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 88 - protein, 177 aa, Artificial Sequence
  Synthetic sequence TCR17_Cb (S57C mod)
EDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 89 - protein, 179 aa, Artificial Sequence
  Synthetic sequence TCR14_Cb (S57C mod)
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 90 - protein, 179 aa, Artificial Sequence; identical to SEQ ID NO: 89
  Synthetic sequence TCR18_Cb (S57C mod)

SEQ ID NO: 91 - protein, 179 aa, Artificial Sequence; identical to SEQ ID NO: 89
  Synthetic sequence 91 - TCR13_Cb (S57C mod)

SEQ ID NO: 92 - protein, 179 aa, Artificial Sequence; identical to SEQ ID NO: 89
  Synthetic sequence A11_TCR22_Cb (S57C mod)

SEQ ID NO: 93 - protein, 179 aa, Artificial Sequence; identical to SEQ ID NO: 89
  Synthetic sequence TCR19_Cb (S57C mod)

SEQ ID NO: 94 - protein, 179 aa, Artificial Sequence; identical to SEQ ID NO: 89
  Synthetic sequence TCR16_Cb (S57C mod)

SEQ ID NO: 95 - protein, 178 aa, Artificial Sequence
  Synthetic sequence TCR20_Cb (S57C mod)
DLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 96 - protein, 179 aa, Artificial Sequence; identical to SEQ ID NO: 89
  Synthetic sequence TCR21_Cb (S57C mod)

SEQ ID NO: 97 - protein, 179 aa, Artificial Sequence; identical to SEQ ID NO: 89
  Synthetic sequence TCR24_Cb (S57C mod)

SEQ ID NO: 98 - protein, 179 aa, Artificial Sequence; identical to SEQ ID NO: 89
  Synthetic sequence TCR23_Cb (S57C mod)

SEQ ID NO: 99 - protein, 177 aa, Artificial Sequence; identical to SEQ ID NO: 88
  Synthetic sequence TCR15_Cb (S57C mod)

SEQ ID NO: 100 - protein, 292 aa, Artificial Sequence
  Synthetic sequence TCR17_B-chain (Cys-mod) (leader sequence removed)
DVKVTQSSRYLVKRTGEKVFLECVQDMDHENMFWYRQDPGLGLRLIYFSYDVKMKEKGDIPEGYSVSREKKERFSLILESASTNQTSMYLCASSLGAGQHNSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 101 - protein, 259 aa, Artificial Sequence
  Synthetic sequence TCR17_A-chain (Cys-mod) (leader sequence removed)
AQKVTQAQTEISVVEKEDVTLDCVYETRDTTYYLFWYKQPPSGELVFLIRRNSFDEQNEISGRYSWNFQKSTSSFNFTITASQVVDSAVYFCALSEVHASGGSYIPTFGRGTSLIVHPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 102 - protein, 293 aa, Artificial Sequence
  Synthetic sequence TCR14_B-chain (Cys-mod) (leader sequence removed)
DSGVTQTPKHLITATGQRVTLRCSPRSGDLSVYWYQQSLDQGLQFLIQYYNGEERAKGNILERFSAQQFPDLHSELNLSSLELGDSALYFCASTHGRDSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 103 - protein, 253 aa, Artificial Sequence
  Synthetic sequence TCR14_A-chain (Cys-mod) (leader sequence removed)
SQQGEEDPQALSIQEGENATMNCSYKTSINNLQWYRQNSGRGLVHLILIRSNEREKHSGRLRVTLDTSKKSSSLLITASRAADTASYFCATDEGGGADGLTFGKGTHLIIQPYIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 104 - protein, 292 aa, Artificial Sequence
  Synthetic sequence TCR18_B-chain (Cys-mod) (leader sequence removed)
DSGVTQTPKHLITATGQRVTLRCSPRSGDLSVYWYQQSLDQGLQFLIQYYNGEERAKGNILERFSAQQFPDLHSELNLSSLELGDSALYFCASSVTWGPYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 105 - protein, 253 aa, Artificial Sequence; identical to SEQ ID NO: 103
  Synthetic sequence TCR18_A-chain (Cys-mod) (leader sequence removed)

SEQ ID NO: 106 - protein, 291 aa, Artificial Sequence
  Synthetic sequence TCR13_B-chain (Cys-mod) (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSEGLYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 107 - protein, 253 aa, Artificial Sequence
  Synthetic sequence TCR13_A-chain (Cys-mod) (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSASAAGNKLTFGGGTRVLVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 108 - protein, 291 aa, Artificial Sequence
  Synthetic sequence TCR22_B-chain (Cys-mod) (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSQGLYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 109 - protein, 253 aa, Artificial Sequence
  Synthetic sequence TCR22_A-chain (Cys-mod) (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSAGAAGNKLTFGGGTRVLVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 110 - protein, 294 aa, Artificial Sequence
  Synthetic sequence TCR19_B-chain (Cys-mod) (leader sequence removed)
DAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSPTGGGMLGQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 111 - protein, 252 aa, Artificial Sequence
  Synthetic sequence TCR19_A-chain (Cys-mod) (leader sequence removed)
DQQVKQNSPSLSVQEGRISILNCDYTNSMFDYFLWYKKYPAEGPTFLISISSIKDKNEDGRFTVFLNKSAKHLSLHIVPSQPGDSAVYFCAASANNNDMRFGAGTRLTVKPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 112 - protein, 293 aa, Artificial Sequence
  Synthetic sequence TCR16_B-chain (Cys-mod) (leader sequence removed)
DAGVIQSPRHEVTEMGQEVTLRCKPISGHDYLFWYRQTMMRGLELLIYFNNNVPIDDSGMPEDRFSAKMPNASFSTLKIQPSEPRDSAVYFCASSRLGPYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 113 - protein, 245 aa, Artificial Sequence
  Synthetic sequence TCR16_A-chain (Cys-mod) (leader sequence removed)
KDQVFQPSTVASSEGAVVEIFCNHSVSNAYNFFWYLHFPGCAPRLLVKGSKPSQQGRYNMTYERFSSSLLILQVREADAAVYYCVLNRDDKIIFGKGTRLHILPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 114 - protein, 296 aa, Artificial Sequence
  Synthetic sequence TCR20_B-chain (Cys-mod) (leader sequence removed)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSPTFPAGDRDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 115 - protein, 252 aa, Artificial Sequence
  Synthetic sequence TCR20_A-chain (Cys-mod) (leader sequence removed)
DAKTTQPPSMDCAEGRAANLPCNHSTISGNEYVYWYRQIHSQGPQYIIHGLKNNETNEMASLIITEDRKSSTLILPHATLRDTAVYYCIVRLNSGNTPLVFGKGTRLSVIANIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 116 - protein, 291 aa, Artificial Sequence
  Synthetic sequence TCR21_B-chain (Cys-mod) (leader sequence removed)
EADIYQTPRYLVIGTGKKITLECSQTMGHDKMYWYQQDPGMELHLIHYSYGVNSTEKGDLSSESTVSRIRTEHFPLTLESARPSHTSQYLCASSVGLYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 117 - protein, 253 aa, Artificial Sequence
  Synthetic sequence TCR21_A-chain (Cys-mod) (leader sequence removed)
QKEVEQDPGPLSVPEGAIVSLNCTYSNSAFQYFMWYRQYSRKGPELLMYTYSSGNKEDGRFTAQVDKSSKYISLFIRDSQPSDSATYLCAMSGGNAGNMLTFGGGTRLMVKPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 118 - protein, 296 aa, Artificial Sequence
  Synthetic sequence TCR24_B-chain (Cys-mod) (leader sequence removed)
DTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSPPGWELAKNIQYFGAGTRLSVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 119 - protein, 250 aa, Artificial Sequence
  Synthetic sequence TCR24_A-chain (Cys-mod) (leader sequence removed)
GQSLEQPSEVTAVEGAIVQINCTYQTSGFYGLSWYQQHDGGAPTFLSYNALDGLEETGRFSSFLSRSDSYGYLLLQELQMKDSASYFCAGGDSSYKLIFGSGTRLLVRPDIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 120 - protein, 292 aa, Artificial Sequence
  Synthetic sequence TCR23_B-chain (Cys-mod) (leader sequence removed)
DAEITQSPRHKITETGRQVTLACHQTWNHNNMFWYRQDLGHGLRLIHYSYGVQDTNKGEVSDGYSVSRSNTEDLPLTLESAASSQTSVYFCASSEYVGAHEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 121 - protein, 256 aa, Artificial Sequence
  Synthetic sequence TCR23_A-chain (Cys-mod) (leader sequence removed)
TQLLEQSPQFLSIQEGENLTVYCNSSSVFSSLQWYRQEPGEGPVLLVTVVTGGEVKKLKRLTFQFGDARKDSSLHITAAQPGDTGLYLCAGVREAGGTSYGKLTFGQGTILTVHPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 122 - protein, 290 aa, Artificial Sequence
  Synthetic sequence TCR15_B-chain (Cys-mod) (leader sequence removed)
SQTIHQWPATLVQPVGSPLSLECTVEGTSNPNLYWYRQAAGRGLQLLFYSVGIGQISSEVPQNLSASRPQDRQFILSSKKLLLSDSGFYLCAWTLTGFGQPQHFGDGTRLSILEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 123 - protein, 251 aa, Artificial Sequence
  Synthetic sequence TCR15_A-chain (Cys-mod) (leader sequence removed)
QKEVEQNSGPLSVPEGAIASLNCTYSDRGSQSFFWYRQYSGKSPELIMFIYSNGDKEDGRFTAQLNKASQYVSLLIRDSQPSDSATYLCAVNARGNMLTFGGGTRLMVKPHIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 124 - DNA, 405 bp, Artificial Sequence
  Synthetic sequence TCR17_TCRb gene fragment
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagcctgggcgcgggacagcataattcacccctccactttgggaatgggaccaggctcactgtgacagag

SEQ ID NO: 125 - DNA, 438 bp, Artificial Sequence
  Synthetic sequence TCR17_TCRa gene fragment
atgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtgaggttcatgcatcaggaggaagctacatacctacatttggaagaggaaccagccttattgttcatccgtatatccagaaccctgaccctgcc

SEQ ID NO: 126 - DNA, 402 bp, Artificial Sequence
  Synthetic sequence TCR14_TCRb gene fragment
atgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcacccacgggagggacagcacagatacgcagtattttggcccaggcacccggctgacagtgctcgag

SEQ ID NO: 127 - DNA, 420 bp, Artificial Sequence
  Synthetic sequence TCR14_TCRa gene fragment
atggaaactctcctgggagtgtctttggtgattctatggcttcaactggctagggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacgaaggaggaggtgctgacggactcacctttggcaaagggactcatctaatcatccagccctatatccagaaccctgaccctgcc

SEQ ID NO: 128 - DNA, 399 bp, Artificial Sequence
  Synthetic sequence TCR18_TCRb gene fragment
atgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtcacttgggggccctacgagcagtacttcgggccgggcaccaggctcacggtcacagag

SEQ ID NO: 129 - DNA, 420 bp, Artificial Sequence; identical to SEQ ID NO: 127
  Synthetic sequence TCR18_TCRa gene fragment

SEQ ID NO: 130 - DNA, 396 bp, Artificial Sequence
  Synthetic sequence TCR13_TCRb gene fragment
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaagggctttacaatgagcagttcttcgggccagggacacggctcaccgtgctagag

SEQ ID NO: 131 - DNA, 426 bp, Artificial Sequence
  Synthetic sequence TCR13_ TCRa gene fragment
atgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgcaagcgctgcaggcaacaagctaacttttggaggaggaaccagggtgctagttaaaccaaatatccagaaccctgaccctgcc

SEQ ID NO: 132 - DNA, 396 bp, Artificial Sequence
  Synthetic sequence TCR22_TCRb gene fragment
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtcagggactgtacaatgagcagttcttcgggccagggacacggctcaccgtgctagag

SEQ ID NO: 133 - DNA, 426 bp, Artificial Sequence
  Synthetic sequence TCR22_TCRa gene fragment
atgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgcaggagctgcaggcaacaagctaacttttggaggaggaaccagggtgctagttaaaccaaatatccagaaccctgaccctgcc

SEQ ID NO: 134 - DNA, 405 bp, Artificial Sequence
  Synthetic sequence TCR19_TCRb gene fragment
atgggctcctggaccctctgctgtgtgtccctttgcatcctggtagcaaagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagcccgacagggggcggtatgcttgggcagtattttggcccaggcacccggctgacagtgctcgag

SEQ ID NO: 135 - DNA, 435 bp, Artificial Sequence
  Synthetic sequence TCR19_TCRa gene fragment
atggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcgcgaataacaatgacatgcgctttggagcagggaccagactgacagtaaaaccaaatatccagaaccctgaccctgcc

SEQ ID NO: 136 - DNA, 402 bp, Artificial Sequence
  Synthetic sequence A11_TCR16_TCRb gene fragment
atgggctcctggaccctctgctgtgtgtccctttgcatcctggtagcaaagcacacagatgctggagttatccagtcaccccggcacgaggtgacagagatgggacaagaagtgactctgagatgtaaaccaatttcaggacatgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagccgtttgggaccgtacaatgagcagttcttcgggccagggacacggctcaccgtgctagag

SEQ ID NO: 137 - DNA, 411 bp, Artificial Sequence
  Synthetic sequence TCR16_TCRa gene fragment
atggctttgcagagcactctgggggcggtgtggctagggcttctcctcaactctctctggaaggttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgttttgaacagagatgacaagatcatctttggaaaagggacacgacttcatattctccccaatatccagaaccctgaccctgcc

SEQ ID NO: 138 - DNA, 411 bp, Artificial Sequence
  Synthetic sequence TCR20_TCRb gene fragment
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccagcctgcaaagcttgaggactcggccgtgtatctctgtgccagcagccccacgttcccagcgggagatagagatacgcagtattttggcccaggcacccggctgacagtgctcgag

SEQ ID NO: 139 - DNA, 408 bp, Artificial Sequence
  Synthetic sequence TCR20_ TCRa gene fragment
atgaggctggtggcaagagtaactgtgtttctgacctttggaactataattgatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagattaaattcaggaaacacacctcttgtctttggaaagggcacaagactttctgtgattgcaaatatccagaaccctgaccctgcc

SEQ ID NO: 140 - DNA, 396 bp, Artificial Sequence
  Synthetic sequence TCR21_TCRb gene fragment
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgtgggcttgtacaatgagcagttcttcgggccagggacacggctcaccgtgctagag

SEQ ID NO: 141 - DNA, 426 bp, Artificial Sequence
  Synthetic sequence TCR21_TCRa gene fragment
atgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgggggtaatgcaggcaacatgctcacctttggagggggaacaaggttaatggtcaaaccccatatccagaaccctgaccctgcc

SEQ ID NO: 142 - DNA, 411 bp, Artificial Sequence
  Synthetic sequence TCR24_TCRb gene fragment
atgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcccccctgggtgggagctagccaaaaacattcagtacttcggcgccgggacccggctctcagtgctggag

SEQ ID NO: 143 - DNA, 402 bp, Artificial Sequence
  Synthetic sequence TCR24_TCRa gene fragment
atgtggggagctttccttctctatgtttccatgaagatgggaggcactgcaggacaaagccttgagcagccctctgaagtgacagctgtggaaggagccattgtccagataaactgcacgtaccagacatctgggttttatgggctgtcctggtaccagcaacatgatggcggagcacccacatttctttcttacaatgctctggatggtttggaggagacaggtcgtttttcttcattccttagtcgctctgatagttatggttacctccttctacaggagctccagatgaaagactctgcctcttacttctgcgctgggggggatagcagctataaattgatcttcgggagtgggaccagactgctggtcaggcctgatatccagaaccctgaccctgcc

SEQ ID NO: 144 - DNA, 399 bp, Artificial Sequence
  Synthetic sequence TCR23_TCRb gene fragment
atgggcacgaggctcttcttctatgtggccctttgtctgctgtgggcaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcaagacactaacaaaggagaagtctcagatggctacagtgtctctagatcaaacacagaggacctccccctcactctggagtctgctgcctcctcccagacatctgtatatttctgcgccagcagtgagtatgtgggggcccacgagcagtacttcgggccgggcaccaggctcacggtcacagag

SEQ ID NO: 145 - DNA, 423 bp, Artificial Sequence
  Synthetic sequence TCR23_TCRa gene fragment
atggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagtgagagaagctggtggtactagctatggaaagctgacatttggacaagggaccatcttgactgtccatccaaatatccagaaccctgaccctgcc

SEQ ID NO: 146 - DNA, 393 bp, Artificial Sequence
  Synthetic sequence TCR15_TCRb gene fragment
atgctctgctctctccttgcccttctcctgggcactttctttggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctcctcctcagtgactctggcttctatctctgtgcctggactctgacagggtttggtcagccccagcattttggtgatgggactcgactctccatcctagag

SEQ ID NO: 147 - DNA, 417 bp, Artificial Sequence
  Synthetic sequence TCR15_TCRa gene fragment
atgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaacgctaggggcaacatgctcacctttggagggggaacaaggttaatggtcaaaccccatatccagaaccctgaccctgcc

SEQ ID NO: 148 - DNA, 405 bp, Artificial Sequence
  Synthetic sequence TCR17_TCRb gene fragment (nt - codon-optimized)
atgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctcttctcttggagctggacagcacaattctcctctgcactttggaaatggcaccagactgaccgtgacagag

SEQ ID NO: 149 - DNA, 439 bp, Artificial Sequence
  Synthetic sequence TCR17_TCRa gene fragment (nt - codon-optimized)
atgttgaccgcttctctcttacgtgccgtgattgccagcatctgtgtggtgtcttctatggcccagaaggttacacaggctcagacagagatcagcgttgtggagaaggaggatgtgaccctggattgcgtgtacgagacaagagataccacctactacctgttctggtacaagcagcctccttctggcgaactggtgttcctgatccggagaaacagctttgatgagcagaacgagattagcggcaggtatagctggaacttccagaagagcaccagcagcttcaacttcaccatcacagcctctcaggtggtggattctgccgtgtacttttgtgccctgtctgaggtgcatgcttctggaggaagctatatccccacctttggaagaggcacctctctgattgtgcacccctacatccagaatcctgatcctgctt

SEQ ID NO: 150 - DNA, 402 bp, Artificial Sequence
  Synthetic sequence TCR14_TCRb gene fragment (nt - codon-optimized)
atgggcttcagactcttatgctgcgtggccttttgtctgcttggagctggacctgtggattctggagttacccagacacctaaacacctgatcaccgctacaggacagagagtgaccctgagatgtagccctagaagcggagatctgtctgtgtactggtatcagcagagcctggatcaaggactgcagttcctgatccagtactacaacggcgaggaaagagccaaaggcaacatcctggagagatttagcgcccagcagttccctgatctgcattctgagctgaatctgagcagcctggaactgggagattctgctctgtacttctgtgccagcacacatggcagagattctaccgatacccagtactttggccctggcacaagactgacagttctggag

SEQ ID NO: 151 - DNA, 420 bp, Artificial Sequence
  Synthetic sequence TCR14_TCRa gene fragment (nt - codon-optimized)
atggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccacagatgaaggaggaggagctgatggactgacatttggaaagggcacacacctgatcatccagccctacatccagaatcctgatcctgcc

SEQ ID NO: 152 - DNA, 399 bp, Artificial Sequence
  Synthetic sequence TCR18_TCRb gene fragment (nt - codon-optimized)
atgggcttcagactcttatgctgcgtggccttttgtctgcttggagctggacctgtggattctggagttacccagacacctaaacacctgatcaccgctacaggacagagagtgaccctgagatgtagccctagaagcggagatctgtctgtgtactggtatcagcagagcctggatcaaggactgcagttcctgatccagtactacaacggcgaggaaagagccaaaggcaacatcctggagagatttagcgcccagcagttccctgatctgcattctgagctgaatctgagcagcctggaactgggagattctgctctgtacttctgtgcctctagcgtgacatggggcccttatgagcagtactttggacctggcacaagactgacagtgacagag

SEQ ID NO: 153 - DNA, 420 bp, Artificial Sequence; identical to SEQ ID NO: 151
  Synthetic sequence TCR18_TCRa gene fragment (nt - codon-optimized)

SEQ ID NO: 154 - DNA, 396 bp, Artificial Sequence
  Synthetic sequence TCR13_TCRb gene fragment (nt - codon-optimized)
atgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctgaaggcctgtacaacgagcagttctttggacctggcaccagactgacagtgcttgaa

SEQ ID NO: 155 - DNA, 426 bp, Artificial Sequence
  Synthetic sequence TCR13_ TCRa gene fragment (nt - codon-optimized)
atgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctgcttctgctgccggcaataaactgacatttggaggaggcacaagagtgctggtgaagcccaacatccagaatcctgatcccgcc

SEQ ID NO: 156 - DNA, 396 bp, Artificial Sequence
  Synthetic sequence TCR22_TCRb gene fragment (nt - codon-optimized)
atgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctcagggcctgtacaatgagcagtttttcggacctggcaccagactgacagtgcttgaa

SEQ ID NO: 157 - DNA, 426 bp, Artificial Sequence
  Synthetic sequence TCR22_TCRa gene fragment (nt - codon-optimized)
atgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctgctggagctgctggcaataaactgacatttggaggaggcacaagagtgctggtgaagcccaacatccagaatcccgatcccgct

SEQ ID NO: 158 - DNA, 405 bp, Artificial Sequence
  Synthetic sequence TCR19_TCRb gene fragment (nt - codon-optimized)
atgggaagctggacactgtgttgcgttagcctgtgtatcctggtggccaaacacacagatgctggagtgattcagagccctagacacgaggtgacagagatgggacaggaagtgacactgagatgtaagcccattagcggacacgactacctgttctggtacaggcagaccatgatgagaggactggaactgctgatctacttcaacaacaacgtgcccatcgacgatagcggcatgcctgaggacagatttagcgccaagatgcctaatgccagcttttctaccctgaagatccagccctctgagcccagagattctgccgtgtacttttgtgcctctagccctacaggaggaggaatgttaggccagtacttcggacctggaaccagactgacagtgcttgaa

SEQ ID NO: 159 - DNA, 435 bp, Artificial Sequence
  Synthetic sequence TCR19_TCRa gene fragment (nt - codon-optimized)
atggccatgttactaggagcgagcgtgctgattctgtggttacagcctgattgggtgaactctcagcagaagaacgatgatcagcaggtgaagcagaacagcccctctctgtctgtgcaggaaggcagaatcagcatcctgaattgcgattacaccaacagcatgttcgactacttcctgtggtacaagaagtaccccgccgagggccctacctttctgatcagcatctctagcatcaaggacaagaacgaagatggcagattcaccgtgttcctgaacaagagcgccaagcacctgagcctgcacattgtgccttctcaacctggagattctgccgtgtacttttgtgctgcctctgccaacaacaacgacatgaggtttggagccggaaccagactgaccgtgaagcctaatatccagaatcccgatcctgct

SEQ ID NO: 160 - DNA, 402 bp, Artificial Sequence
  Synthetic sequence TCR16_TCRb gene fragment (nt - codon-optimized)
atgggaagctggacactgtgttgcgttagcctgtgtatcctggtggccaaacacacagatgctggagtgattcagagccctagacacgaggtgacagagatgggacaggaagtgacactgagatgtaagcccattagcggacacgactacctgttctggtacaggcagaccatgatgagaggactggaactgctgatctacttcaacaacaacgtgcccatcgacgatagcggcatgcctgaggacagatttagcgccaagatgcctaatgccagcttttctaccctgaagatccagccctctgagcccagagattctgccgtgtacttttgtgccagcagcagattaggcccctataatgagcagttcttcggccctggcacaagactgacagttcttgag

SEQ ID NO: 161 - DNA, 411 bp, Artificial Sequence
  Synthetic sequence TCR16_TCRa gene fragment (nt - codon-optimized)
atggctctgcaatctacacttggcgctgtttggcttggacttctgctgaactctctgtggaaagtggccgagagcaaggatcaggttttccagccttctacagtggcctcttctgaaggagctgtggtggagatcttctgcaaccactctgtgtctaacgcctacaacttcttctggtacctgcacttccctggctgtgcccctagactgctggttaagggatctaagccttctcaacaaggcagatacaacatgacctacgagcgcttcagcagcagcctgctgatcctgcaggtgagagaagctgatgctgctgtgtattattgtgtgctgaacagggacgacaagatcatcttcggcaagggcaccaggctgcacatcctgcctaatatccagaatcctgatcctgcc

SEQ ID NO: 162 - DNA, 411 bp, Artificial Sequence
  Synthetic sequence TCR20_TCRb gene fragment (nt - codon-optimized)
atgggcacaagacttctctgttgggctgctctttgtctgcttggagctgaactgacagaagctggagttgcccagtctcctaggtacaagatcatcgagaagaggcagtctgtggccttttggtgcaatcccattagcggacacgccaccctgtactggtatcagcaaattctgggacaaggccctaaactgctgatccagttccagaacaacggcgtggtggacgattctcaactgcctaaggacaggttttctgccgagagactgaaaggcgtggatagcaccctgaagatccaaccagccaaactggaggattctgctgtgtacctgtgtgcttctagccctacctttcctgccggagatagagacacccagtactttggacctggcacaagactgacagttctggag

SEQ ID NO: 163 - DNA, 408 bp, Artificial Sequence
  Synthetic sequence TCR20_ TCRa gene fragment (nt - codon-optimized)
atgagactggtggcacgcgtaactgtgtttctgacctttggcaccatcatcgatgccaagacaacccaacctcctagcatggactgtgccgagggaagagctgctaatctgccttgtaatcacagcacaatcagcggcaacgagtacgtgtactggtaccggcagatccactctcaaggacctcagtacatcattcatggcctgaagaacaacgagaccaacgagatggccagcctgatcatcaccgaggacaggaagtcttctaccctgattctgcctcatgctacactgagagataccgccgtgtactactgcatcgtgcggctgaatagcggcaatacaccactggtgtttggaaaaggcacaaggctgagcgtgatcgccaatatccagaaccctgaccctgct

SEQ ID NO: 164 - DNA, 396 bp, Artificial Sequence
  Synthetic sequence TCR21_TCRb gene fragment (nt - codon-optimized)
atgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctgtgggcctgtacaatgagcagtttttcggacctggcaccagactgacagtgcttgaa

SEQ ID NO: 165 - DNA, 426 bp, Artificial Sequence
  Synthetic sequence TCR21_TCRa gene fragment (nt - codon-optimized)
atgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctggcggaaatgccggaaatatgctgacatttggaggaggcacaaggctgatggtgaaaccccacatccagaaccctgatcctgct

SEQ ID NO: 166 - DNA, 411 bp, Artificial Sequence
  Synthetic sequence TCR24_TCRb gene fragment (nt - codon-optimized)
atgggcacatctcttctctgctggatggctctttgtctgcttggagccgatcatgccgatacaggagttagccagaaccctagacacaagatcaccaagagaggccagaatgtgaccttccggtgcgatcctattagcgagcacaacaggctgtactggtacagacaaacactgggacaaggacctgagttcctgacctacttccagaacgaagcccagctggagaagagtcgactcctgagcgacagatttagcgccgagagacctaaaggcagctttagcaccctggagatccagagaacagaacagggcgattctgccatgtacctgtgtgcttctagccctcctggatgggaactggccaagaatatccagtactttggagccggcacaagactgtctgttctggag

SEQ ID NO: 167 - DNA, 402 bp, Artificial Sequence
  Synthetic sequence TCR24_TCRa gene fragment (nt - codon-optimized)
atgtggggcgcttttcttctgtatgtgagcatgaagatgggcggaacagctggacagtctctggaacagcctagcgaggttacagctgttgaaggagctattgtgcagatcaactgcacctaccagacaagcggcttctacggcctgagctggtatcaacagcacgatggaggagctcctacatttctgagctataatgccctggatggcctggaggagacaggcagatttagcagcttcctgagcagatctgactcttacggatatctgctgctgcaggagctgcagatgaaggatagcgccagctacttttgtgctggaggagatagctcttacaagctgatcttcggcagcggcacaagactgctggtgagacctgatatccagaatcctgatcctgct

SEQ ID NO: 168 - DNA, 399 bp, Artificial Sequence
  Synthetic sequence TCR23_TCRb gene fragment (nt - codon-optimized)
atgggcacacggctgtttttctacgttgccctttgtctgctttgggctggccatagagatgccgagattacccagagccccagacacaaaattaccgagacaggaagacaggtgacactggcctgtcaccagacatggaaccacaacaacatgttctggtacaggcaggatctgggacatggactgcggctgatccactactcttatggcgtgcaggataccaataaaggcgaagtgtctgacggctacagcgtgagcaggagcaataccgaagatctgcctctgacactggaatctgctgcttcttctcagacaagcgtgtacttctgcgcctctagcgagtatgtgggagcccatgaacagtactttggacctggcacaagactgacagtgacagag

SEQ ID NO: 169 - DNA, 423 bp, Artificial Sequence
  Synthetic sequence TCR23_TCRa gene fragment (nt - codon-optimized)
atggtgctgaagttctctgtctcgatcctgtggatccagcttgcttgggtgtctacacagctgctggaacagtctcctcagtttctgagcattcaggaaggcgagaatctgaccgtgtactgcaacagcagcagcgtgtttagcagcttacagtggtacagacaggagcctggagaaggaccagtgttactggtgacagtggtgacaggaggagaagtgaagaagctgaagagactgaccttccagttcggcgatgccagaaaggatagctctctgcacatcacagctgctcaacctggagacacaggcctgtatctgtgtgccggagtgagagaagctggaggaacatcttatggcaagctgacctttggacagggcacaatcctgacagtgcaccccaatatccagaaccctgatcctgct

SEQ ID NO: 170 - DNA, 393 bp, Artificial Sequence
  Synthetic sequence TCR15_TCRb gene fragment (nt - codon-optimized)
atgctgtgctctcttcttgcccttctgctgggcaccttttttggcgtgagatctcagaccattcaccaatggcctgctacattagtgcagcctgtgggcagccctctttctctggagtgtacagtggaaggaacaagcaatcccaacctttactggtacagacaggccgccggaagaggactgcagctgctgttttactctgtgggaattggacagattagctctgaagttccccagaacctgtccgcctccagaccccaggatagacagttcattctgagctctaagaaacttctgctgagcgatagcggcttctacctgtgcgcctggaccctgacaggatttggacaacctcaacattttggagatggcacaaggctgagcattctggag

SEQ ID NO: 171 - DNA, 417 bp, Artificial Sequence
  Synthetic sequence TCR15_TCRa gene fragment (nt - codon-optimized)
atgaagagcctgagagtcctgctggtgattttgtggctgcagctgtcttgggtttggtctcagcagaaagaagtggagcagaatagcggccctctgtctgttcctgaaggcgctattgctagcctgaattgcacatacagcgatagaggatctcagagcttcttctggtaccggcagtacagcggcaagagcccagaactgatcatgttcatctacagcaatggcgacaaggaggatggcaggtttacagcccagctgaacaaggccagccagtatgtttctctgctgatcagagatagccagcctagcgattctgccacctacctgtgtgccgtgaacgctagaggaaatatgctgacatttggaggcggcacaagactgatggtgaagccccatatccagaaccccgatcctgct

SEQ ID NO: 172 - DNA, 66 bp, Artificial Sequence
  Synthetic sequence P2A-1 (codon-optimized)
ggaagtggagctacgaatttttctttattaaaacaagcaggagatgttgaggagaatcccggtcca

SEQ ID NO: 173 - DNA, 63 bp, Artificial Sequence
  Synthetic sequence P2A-2 (codon-optimized)
agcggcgccaccaacttcagcctgctgaaacaggccggcgacgtggaagagaaccctggccct

SEQ ID NO: 174 - DNA, 65 bp, Artificial Sequence
  Synthetic sequence P2A-3 (codon-optimized)
gaagcggcgccacaaatttcagcctgctgaagcaggccggcgacgtggaagagaaccctggccct

SEQ ID NO: 175 - DNA, 66 bp, Artificial Sequence
  Synthetic sequence P2A-4 (codon-optimized)
ggctccggcgccaccaacttttcactgctgaaacaggctggggatgtggaagaaaatcccggccca

SEQ ID NO: 176 - DNA, 66 bp, Artificial Sequence
  Synthetic sequence P2A-5
ggcagcggcgccaccaactttagcctgctgaaacaggctggcgacgtggaagagaaccccggacct

SEQ ID NO: 177 - DNA, 66 bp, Artificial Sequence
  Synthetic sequence P2A-6
ggctctggcgccaccaactttagcctgctgaaacaggctggcgacgtggaagagaaccccggacct

SEQ ID NO: 178 - DNA, 63 bp, Artificial Sequence
  Synthetic sequence T2A
ggaagcggagagggcagaggaagtctgctaacatgcggtgacgtcgaggagaatcctggacct

SEQ ID NO: 179 - DNA, 69 bp, Artificial Sequence
  Synthetic sequence E2A
ggaagcggacagtgtactaattatgctctcttgaaattggctggagatgttgagagcaaccctggacct

SEQ ID NO: 180 - DNA, 75 bp, Artificial Sequence
  Synthetic sequence F2A
ggaagcggagtgaaacagactttgaattttgaccttctcaagttggcgggagacgtggagtccaaccctggacct

SEQ ID NO: 181 - protein, 22 aa, Artificial Sequence
  Synthetic sequence P2A-1
GSGATNFSLLKQAGDVEENPGP

SEQ ID NO: 182 - protein, 21 aa, Artificial Sequence
  Synthetic sequence P2A-2
SGATNFSLLKQAGDVEENPGP

SEQ ID NO: 183 - protein, 21 aa, Artificial Sequence
  Synthetic sequence T2A
GSGEGRGSLLTCGDVEENPGP

SEQ ID NO: 184 - protein, 23 aa, Artificial Sequence
  Synthetic sequence E2A
GSGQCTNYALLKLAGDVESNPGP

SEQ ID NO: 185 - protein, 25 aa, Artificial Sequence
  Synthetic sequence F2A
GSGVKQTLNFDLLKLAGDVESNPGP

SEQ ID NO: 186 - DNA, 1511 bp, Artificial Sequence
  Synthetic sequence TCR17_TCRb-p2a-TCRa seq (codon-optimized, with Gibson ends)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctcttctcttggagctggacagcacaattctcctctgcactttggaaatggcaccagactgaccgtgacagaggatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatgttgaccgcttctctcttacgtgccgtgattgccagcatctgtgtggtgtcttctatggcccagaaggttacacaggctcagacagagatcagcgttgtggagaaggaggatgtgaccctggattgcgtgtacgagacaagagataccacctactacctgttctggtacaagcagcctccttctggcgaactggtgttcctgatccggagaaacagctttgatgagcagaacgagattagcggcaggtatagctggaacttccagaagagcaccagcagcttcaacttcaccatcacagcctctcaggtggtggattctgccgtgtacttttgtgccctgtctgaggtgcatgcttctggaggaagctatatccccacctttggaagaggcacctctctgattgtgcacccctacatccagaatcctgatcctgctgtgtaccagctgcgggacagcaagagcagcgac

SEQ ID NO: 187 - DNA, 1496 bp, Artificial Sequence
  Synthetic sequence TCR14_TCRb-p2a-TCRa seq (codon-optimized, with Gibson ends)
ctcaataaaagagcccacaacccctcactcggcgcgccaccatgggcttcagactcttatgctgcgtggccttttgtctgcttggagctggacctgtggattctggagttacccagacacctaaacacctgatcaccgctacaggacagagagtgaccctgagatgtagccctagaagcggagatctgtctgtgtactggtatcagcagagcctggatcaaggactgcagttcctgatccagtactacaacggcgaggaaagagccaaaggcaacatcctggagagatttagcgcccagcagttccctgatctgcattctgagctgaatctgagcagcctggaactgggagattctgctctgtacttctgtgccagcacacatggcagagattctaccgatacccagtactttggccctggcacaagactgacagttctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccacagatgaaggaggaggagctgatggactgacatttggaaagggcacacacctgatcatccagccctacatccagaatcctgatcctgccgtgtaccagctgcgggacagcaagagcagcgac

SEQ ID NO: 188 - DNA, 1493 bp, Artificial Sequence
  Synthetic sequence TCR18_TCRb-p2a-TCRa seq (codon-optimized, with Gibson ends)
ctcaataaaagagcccacaacccctcactcggcgcgccaccatgggcttcagactcttatgctgcgtggccttttgtctgcttggagctggacctgtggattctggagttacccagacacctaaacacctgatcaccgctacaggacagagagtgaccctgagatgtagccctagaagcggagatctgtctgtgtactggtatcagcagagcctggatcaaggactgcagttcctgatccagtactacaacggcgaggaaagagccaaaggcaacatcctggagagatttagcgcccagcagttccctgatctgcattctgagctgaatctgagcagcctggaactgggagattctgctctgtacttctgtgcctctagcgtgacatggggcccttatgagcagtactttggacctggcacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccacagatgaaggaggaggagctgatggactgacatttggaaagggcacacacctgatcatccagccctacatccagaatcctgatcctgccgtgtaccagctgcgggacagcaagagcagcgac

SEQ ID NO: 189 - DNA, 1496 bp, Artificial Sequence
  Synthetic sequence TCR13_TCRb-p2a-TCRa seq (codon-optimized, with Gibson ends)
ctcaataaaagagcccacaacccctcactcggcgcgccaccatgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctgaaggcctgtacaacgagcagttctttggacctggcaccagactgacagtgcttgaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctgcttctgctgccggcaataaactgacatttggaggaggcacaagagtgctggtgaagcccaacatccagaatcctgatcccgccgtgtaccagctgcgggacagcaagagcagcgac

SEQ ID NO: 190 - DNA, 1496 bp, Artificial Sequence
  Synthetic sequence TCR22_TCRb-p2a-TCRa seq (codon-optimized, with Gibson ends)
ctcaataaaagagcccacaacccctcactcggcgcgccaccatgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctcagggcctgtacaatgagcagtttttcggacctggcaccagactgacagtgcttgaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctgctggagctgctggcaataaactgacatttggaggaggcacaagagtgctggtgaagcccaacatccagaatcccgatcccgctgtgtaccagctgcgggacagcaagagcagcgac

SEQ ID NO: 191 - DNA, 1514 bp, Artificial Sequence
  Synthetic sequence TCR19_TCRb-p2a-TCRa seq (codon-optimized, with Gibson ends)
ctcaataaaagagcccacaacccctcactcggcgcgccaccatgggaagctggacactgtgttgcgttagcctgtgtatcctggtggccaaacacacagatgctggagtgattcagagccctagacacgaggtgacagagatgggacaggaagtgacactgagatgtaagcccattagcggacacgactacctgttctggtacaggcagaccatgatgagaggactggaactgctgatctacttcaacaacaacgtgcccatcgacgatagcggcatgcctgaggacagatttagcgccaagatgcctaatgccagcttttctaccctgaagatccagccctctgagcccagagattctgccgtgtacttttgtgcctctagccctacaggaggaggaatgttaggccagtacttcggacctggaaccagactgacagtgcttgaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggccatgttactaggagcgagcgtgctgattctgtggttacagcctgattgggtgaactctcagcagaagaacgatgatcagcaggtgaagcagaacagcccctctctgtctgtgcaggaaggcagaatcagcatcctgaattgcgattacaccaacagcatgttcgactacttcctgtggtacaagaagtaccccgccgagggccctacctttctgatcagcatctctagcatcaaggacaagaacgaagatggcagattcaccgtgttcctgaacaagagcgccaagcacctgagcctgcacattgtgccttctcaacctggagattctgccgtgtacttttgtgctgcctctgccaacaacaacgacatgaggtttggagccggaaccagactgaccgtgaagcctaatatccagaatcccgatcctgctgtgtaccagctgcgggacagcaagagcagcgac

SEQ ID NO: 192 - DNA, 1487 bp, Artificial Sequence
  Synthetic sequence TCR16_TCRb-p2a-TCRa seq (codon-optimized, with Gibson ends)
ctcaataaaagagcccacaacccctcactcggcgcgccaccatgggaagctggacactgtgttgcgttagcctgtgtatcctggtggccaaacacacagatgctggagtgattcagagccctagacacgaggtgacagagatgggacaggaagtgacactgagatgtaagcccattagcggacacgactacctgttctggtacaggcagaccatgatgagaggactggaactgctgatctacttcaacaacaacgtgcccatcgacgatagcggcatgcctgaggacagatttagcgccaagatgcctaatgccagcttttctaccctgaagatccagccctctgagcccagagattctgccgtgtacttttgtgccagcagcagattaggcccctataatgagcagttcttcggccctggcacaagactgacagttcttgaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggctctgcaatctacacttggcgctgtttggcttggacttctgctgaactctctgtggaaagtggccgagagcaaggatcaggttttccagccttctacagtggcctcttctgaaggagctgtggtggagatcttctgcaaccactctgtgtctaacgcctacaacttcttctggtacctgcacttccctggctgtgcccctagactgctggttaagggatctaagccttctcaacaaggcagatacaacatgacctacgagcgcttcagcagcagcctgctgatcctgcaggtgagagaagctgatgctgctgtgtattattgtgtgctgaacagggacgacaagatcatcttcggcaagggcaccaggctgcacatcctgcctaatatccagaatcctgatcctgccgtgtaccagctgcgggacagcaagagcagcgac

SEQ ID NO: 193 - DNA, 1493 bp, Artificial Sequence
  Synthetic sequence TCR20_TCRb-p2a-TCRa seq (codon-optimized, with Gibson ends)
ctcaataaaagagcccacaacccctcactcggcgcgccaccatgggcacaagacttctctgttgggctgctctttgtctgcttggagctgaactgacagaagctggagttgcccagtctcctaggtacaagatcatcgagaagaggcagtctgtggccttttggtgcaatcccattagcggacacgccaccctgtactggtatcagcaaattctgggacaaggccctaaactgctgatccagttccagaacaacggcgtggtggacgattctcaactgcctaaggacaggttttctgccgagagactgaaaggcgtggatagcaccctgaagatccaaccagccaaactggaggattctgctgtgtacctgtgtgcttctagccctacctttcctgccggagatagagacacccagtactttggacctggcacaagactgacagttctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgagactggtggcacgcgtaactgtgtttctgacctttggcaccatcatcgatgccaagacaacccaacctcctagcatggactgtgccgagggaagagctgctaatctgccttgtaatcacagcacaatcagcggcaacgagtacgtgtactggtaccggcagatccactctcaaggacctcagtacatcattcatggcctgaagaacaacgagaccaacgagatggccagcctgatcatcaccgaggacaggaagtcttctaccctgattctgcctcatgctacactgagagataccgccgtgtactactgcatcgtgcggctgaatagcggcaatacaccactggtgtttggaaaaggcacaaggctgagcgtgatcgccaatatccagaaccctgaccctgctgtgtaccagctgcgggacagcaagagcagcgac

SEQ ID NO: 194 - DNA, 1496 bp, Artificial Sequence
  Synthetic sequence TCR21_TCRb-p2a-TCRa seq (codon-optimized, with Gibson ends)
ctcaataaaagagcccacaacccctcactcggcgcgccaccatgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctcttctgtgggcctgtacaatgagcagtttttcggacctggcaccagactgacagtgcttgaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgatgaagagcctgcgagtcctcctggtgattctgtggttacagctgtcttgggtgtggtctcagcagaaagaagtggagcaggatcctggacctctgtctgtgcctgaaggagctattgtgagcctgaattgcacctacagcaatagcgccttccagtacttcatgtggtaccggcagtacagcagaaagggccctgaactgctgatgtacacctactctagcggcaataaggaagatggccggtttacagctcaggtggacaagagcagcaagtacatcagcctgttcatcagggattctcagcctagcgattctgccacctacctgtgtgccatgtctggcggaaatgccggaaatatgctgacatttggaggaggcacaaggctgatggtgaaaccccacatccagaaccctgatcctgctgtgtaccagctgcgggacagcaagagcagcgac

SEQ ID NO: 195 - DNA, 1487 bp, Artificial Sequence
  Synthetic sequence TCR24_TCRb-p2a-TCRalpha seq (codon-optimized, with Gibson ends)
ctcaataaaagagcccacaacccctcactcggcgcgccaccatgggcacatctcttctctgctggatggctctttgtctgcttggagccgatcatgccgatacaggagttagccagaaccctagacacaagatcaccaagagaggccagaatgtgaccttccggtgcgatcctattagcgagcacaacaggctgtactggtacagacaaacactgggacaaggacctgagttcctgacctacttccagaacgaagcccagctggagaagagtcgactcctgagcgacagatttagcgccgagagacctaaaggcagctttagcaccctggagatccagagaacagaacagggcgattctgccatgtacctgtgtgcttctagccctcctggatgggaactggccaagaatatccagtactttggagccggcacaagactgtctgttctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgtggggcgcttttcttctgtatgtgagcatgaagatgggcggaacagctggacagtctctggaacagcctagcgaggttacagctgttgaaggagctattgtgcagatcaactgcacctaccagacaagcggcttctacggcctgagctggtatcaacagcacgatggaggagctcctacatttctgagctataatgccctggatggcctggaggagacaggcagatttagcagcttcctgagcagatctgactcttacggatatctgctgctgcaggagctgcagatgaaggatagcgccagctacttttgtgctggaggagatagctcttacaagctgatcttcggcagcggcacaagactgctggtgagacctgatatccagaatcctgatcctgctgtgtaccagctgcgggacagcaagagcagcgac

SEQ ID NO: 196 - DNA, 1372 bp, Artificial Sequence
  Synthetic sequence TCR23_TCRb-p2a-TCRa seq (codon-optimized, with Gibson ends)
acacaaaattaccgagacaggaagacaggtgacactggcctgtcaccagacatggaaccacaacaacatgttctggtacaggcaggatctgggacatggactgcggctgatccactactcttatggcgtgcaggataccaataaaggcgaagtgtctgacggctacagcgtgagcaggagcaataccgaagatctgcctctgacactggaatctgctgcttcttctcagacaagcgtgtacttctgcgcctctagcgagtatgtgggagcccatgaacagtactttggacctggcacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggtgctgaagttctctgtctcgatcctgtggatccagcttgcttgggtgtctacacagctgctggaacagtctcctcagtttctgagcattcaggaaggcgagaatctgaccgtgtactgcaacagcagcagcgtgtttagcagcttacagtggtacagacaggagcctggagaaggaccagtgttactggtgacagtggtgacaggaggagaagtgaagaagctgaagagactgaccttccagttcggcgatgccagaaaggatagctctctgcacatcacagctgctcaacctggagacacaggcctgtatctgtgtgccggagtgagagaagctggaggaacatcttatggcaagctgacctttggacagggcacaatcctgacagtgcaccccaatatccagaaccctgatcctgctgtgtaccagctgcgggacagcaagagcagcgac

SEQ ID NO: 197 - DNA, 1352 bp, Artificial Sequence
  Synthetic sequence TCR15_TCRb-p2a-TCRa seq (codon-optimized, with Gibson ends)
tgcagcctgtgggcagccctctttctctggagtgtacagtggaaggaacaagcaatcccaacctttactggtacagacaggccgccggaagaggactgcagctgctgttttactctgtgggaattggacagattagctctgaagttccccagaacctgtccgcctccagaccccaggatagacagttcattctgagctctaagaaacttctgctgagcgatagcggcttctacctgtgcgcctggaccctgacaggatttggacaacctcaacattttggagatggcacaaggctgagcattctggaggatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatgaagagcctgagagtcctgctggtgattttgtggctgcagctgtcttgggtttggtctcagcagaaagaagtggagcagaatagcggccctctgtctgttcctgaaggcgctattgctagcctgaattgcacatacagcgatagaggatctcagagcttcttctggtaccggcagtacagcggcaagagcccagaactgatcatgttcatctacagcaatggcgacaaggaggatggcaggtttacagcccagctgaacaaggccagccagtatgtttctctgctgatcagagatagccagcctagcgattctgccacctacctgtgtgccgtgaacgctagaggaaatatgctgacatttggaggcggcacaagactgatggtgaagccccatatccagaaccccgatcctgctgtgtaccagctgcgggacagcaagagcagcgac

SEQ ID NO: 198 - protein, 10 aa, Artificial Sequence
  Synthetic sequence KRAS 5-14 G12D
KLVVVGADGV

SEQ ID NO: 199 - protein, 9 aa, Artificial Sequence
  Synthetic sequence KRAS 6-14 G12D
LVVVGADGV

SEQ ID NO: 200 - protein, 10 aa, Artificial Sequence
  Synthetic sequence KRAS 5-14 G12V
KLVVVGAVGV

SEQ ID NO: 201 - protein, 9 aa, Artificial Sequence
  Synthetic sequence KRAS 6-14 G12V
LVVVGAVGV

SEQ ID NO: 202 - protein, 146 aa, Artificial Sequence
  Synthetic sequence TCR17a fragment
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALSEVHASGGSYIPTFGRGTSLIVHPYIQNPDPA

SEQ ID NO: 203 - protein, 140 aa, Artificial Sequence
  Synthetic sequence TCR14a fragment
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDEGGGADGLTFGKGTHLIIQPYIQNPDPA

SEQ ID NO: 204 - protein, 140 aa, Artificial Sequence; identical to SEQ ID NO: 203
  Synthetic sequence TCR18a fragment

SEQ ID NO: 205 - protein, 142 aa, Artificial Sequence
  Synthetic sequence TCR13a fragment
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSASAAGNKLTFGGGTRVLVKPNIQNPDPA

SEQ ID NO: 206 - protein, 142 aa, Artificial Sequence
  Synthetic sequence TCR22a fragment
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSAGAAGNKLTFGGGTRVLVKPNIQNPDPA

SEQ ID NO: 207 - protein, 145 aa, Artificial Sequence
  Synthetic sequence TCR19a fragment
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAASANNNDMRFGAGTRLTVKPNIQNPDPA

SEQ ID NO: 208 - protein, 137 aa, Artificial Sequence
  Synthetic sequence TCR16a fragment
MALQSTLGAVWLGLLLNSLWKVAESKDQVFQPSTVASSEGAVVEIFCNHSVSNAYNFFWYLHFPGCAPRLLVKGSKPSQQGRYNMTYERFSSSLLILQVREADAAVYYCVLNRDDKIIFGKGTRLHILPNIQNPDPA

SEQ ID NO: 209 - protein, 136 aa, Artificial Sequence
  Synthetic sequence TCR20a fragment
MRLVARVTVFLTFGTIIDAKTTQPPSMDCAEGRAANLPCNHSTISGNEYVYWYRQIHSQGPQYIIHGLKNNETNEMASLIITEDRKSSTLILPHATLRDTAVYYCIVRLNSGNTPLVFGKGTRLSVIANIQNPDPA

SEQ ID NO: 210 - protein, 142 aa, Artificial Sequence
  Synthetic sequence TCR21a fragment
MMKSLRVLLVILWLQLSWVWSQQKEVEQDPGPLSVPEGAIVSLNCTYSNSAFQYFMWYRQYSRKGPELLMYTYSSGNKEDGRFTAQVDKSSKYISLFIRDSQPSDSATYLCAMSGGNAGNMLTFGGGTRLMVKPHIQNPDPA

SEQ ID NO: 211 - protein, 134 aa, Artificial Sequence
  Synthetic sequence TCR24a fragment
MWGAFLLYVSMKMGGTAGQSLEQPSEVTAVEGAIVQINCTYQTSGFYGLSWYQQHDGGAPTFLSYNALDGLEETGRFSSFLSRSDSYGYLLLQELQMKDSASYFCAGGDSSYKLIFGSGTRLLVRPDIQNPDPA

SEQ ID NO: 212 - protein, 141 aa, Artificial Sequence
  Synthetic sequence TCR23a fragment
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGVREAGGTSYGKLTFGQGTILTVHPNIQNPDPA

SEQ ID NO: 213 - protein, 139 aa, Artificial Sequence
  Synthetic sequence TCR15a fragment
MKSLRVLLVILWLQLSWVWSQQKEVEQNSGPLSVPEGAIASLNCTYSDRGSQSFFWYRQYSGKSPELIMFIYSNGDKEDGRFTAQLNKASQYVSLLIRDSQPSDSATYLCAVNARGNMLTFGGGTRLMVKPHIQNPDPA

SEQ ID NO: 214 - protein, 5 aa, Artificial Sequence
  Synthetic sequence (G-S linker)
GGGGS

SEQ ID NO: 215 - protein, 20 aa, Artificial Sequence
  Synthetic sequence (G-S linker)
  VARIANT (2)...(10): any one or all of amino acids 2-10 can either be present or absent
  VARIANT (12)...(20): any one or all of amino acids 12-20 can either be present or absent
GGGGGGGGGGSSSSSSSSSS

SEQ ID NO: 216 - protein, 189 aa, Artificial Sequence
  Synthetic sequence (human HRAS (UniProt P01112))
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 217 - protein, 5 aa, Artificial Sequence
  Synthetic sequence (A2 KRAS TCR01 - CDRbeta1)
LNHNV

SEQ ID NO: 218 - protein, 6 aa, Artificial Sequence
  Synthetic sequence (A2 KRAS TCR01 - CDRbeta2)
YYDKDF

SEQ ID NO: 219 - protein, 16 aa, Artificial Sequence
  Synthetic sequence (A2 KRAS TCR01 - CDRbeta3)
CATSSLGQGYQETQYF

SEQ ID NO: 220 - protein, 5 aa, Artificial Sequence
  Synthetic sequence (A2 KRAS TCR01 - CDRalpha1)
TSINN

SEQ ID NO: 221 - protein, 7 aa, Artificial Sequence
  Synthetic sequence (A2 KRAS TCR01 - CDRalpha2)
IRSNERE

SEQ ID NO: 222 - protein, 11 aa, Artificial Sequence
  Synthetic sequence (A2 KRAS TCR01 - CDRalpha3)
CATDDDYKLSF

SEQ ID NO: 223 - protein, 5 aa, Artificial Sequence
  Synthetic sequence (A2 KRAS TCR02 - CDRbeta1)
SGHAT

SEQ ID NO: 224 - protein, 6 aa, Artificial Sequence
  Synthetic sequence (A2 KRAS TCR02 - CDRbeta2)
FQDESV

SEQ ID NO: 225 - protein, 13 aa, Artificial Sequence
  Synthetic sequence (A2 KRAS TCR02 - CDRbeta3)
CASSPTGEGEQYF

SEQ ID NO: 226 - protein, 6 aa, Artificial Sequence
  Synthetic sequence (A2 KRAS TCR02 - CDRalpha1)
DSSSTY

SEQ ID NO: 227 - protein, 7 aa, Artificial Sequence
  Synthetic sequence (A2 KRAS TCR02 - CDRalpha2)
IFSNMDM

SEQ ID NO: 228 - protein, 13 aa, Artificial Sequence
  Synthetic sequence (A2 KRAS TCR02 - CDRalpha3)
CAEIEDNTDKLIF

SEQ ID NO: 229 - protein, 5 aa, Artificial Sequence
  Synthetic sequence (A2 KRAS TCR03 - CDRbeta1)
SGHTA

SEQ ID NO: 230 - protein, 6 aa, Artificial Sequence
  Synthetic sequence (A2 KRAS TCR03 - CDRbeta2)
FQGTGA

SEQ ID NO: 231 - protein, 13 aa, Artificial Sequence
  Synthetic sequence (A2 KRAS TCR03 - CDRbeta3)
CASSPLAANEQFF

SEQ ID NO: 232 - protein, 6 aa, Artificial Sequence
  Synthetic sequence (A2 KRAS TCR03 - CDRalpha1)
DSSSTY

SEQ ID NO: 233 - protein, 7 aa, Artificial Sequence
  Synthetic sequence (A2 KRAS TCR03 - CDRalpha2)
IFSNMDM

SEQ ID NO: 234 - protein, 12 aa, Artificial Sequence
  Synthetic sequence (A2 KRAS TCR03 - CDRalpha3)
CAERTDTDKLIF

SEQ ID NO: 235 - protein, 6 aa, Artificial Sequence
  Synthetic sequence (A2 KRAS TCR04 - CDRbeta1)
DFQATT

SEQ ID NO: 236 - protein, 7 aa, Artificial Sequence
  Synthetic sequence (A2 KRAS TCR04 - CDRbeta2)
SNEGSKA

SEQ ID NO: 237 - protein, 14 aa, Artificial Sequence
  Synthetic sequence (A2 KRAS TCR04 - CDRbeta3)
CSAFLSGSADTQYF

SEQ ID NO: 238 - protein, 7 aa, Artificial Sequence
  Synthetic sequence (A2 KRAS TCR04 - CDRalpha1)
TRDTTYY

SEQ ID NO: 239 - protein, 8 aa, Artificial Sequence
  Synthetic sequence (A2 KRAS TCR04 - CDRalpha2)
RNSFDEQN

SEQ ID NO: 240 - protein, 12 aa, Artificial Sequence
  Synthetic sequence (A2 KRAS TCR04 - CDRalpha3)
CALMDSSYKLIF

SEQ ID NO: 241 - protein, 5 aa, Artificial Sequence
  Synthetic sequence (A2 KRAS TCR05 - CDRBETA1)
MDHEN

SEQ ID NO: 242 - protein, 6 aa, Artificial Sequence
  Synthetic sequence (A2 KRAS TCR05 - CDRbeta2)
SYDVKM

SEQ ID NO: 243 - protein, 13 aa, Artificial Sequence
  Synthetic sequence (A2 KRAS TCR05 - CDRbeta3)
CASALRGTYEQYF

SEQ ID NO: 244 - protein, 6 aa, Artificial Sequence
  Synthetic sequence (A2 KRAS TCR05 - CDRalpha1)
YGATPY

SEQ ID NO: 245 - protein, 8 aa, Artificial Sequence
  Synthetic sequence (A2 KRAS TCR05 - CDRalpha2)
YFSGDTLV

SEQ ID NO: 246 - protein, 15 aa, Artificial Sequence
  Synthetic sequence (A2 KRAS TCR05 - CDRalpha3)
CAVGDENTGFQKLVF

SEQ ID NO: 247 - protein, 5 aa, Artificial Sequence
  Synthetic sequence (A2 KRAS TCR06 - CDRbeta1)
MDHEN

SEQ ID NO: 248 - protein, 6 aa, Artificial Sequence
  Synthetic sequence (A2 KRAS TCR06 - CDRbeta2)
SYDVKM

SEQ ID NO: 249 - protein, 14 aa, Artificial Sequence
  Synthetic sequence (A2 KRAS TCR06 - CDRbeta3)
CASSLGDRIYEQYF

SEQ ID NO: 250 - protein, 6 aa, Artificial Sequence
  Synthetic sequence (A2 KRAS TCR06 - CDRalpha1)
DSSSTY

SEQ ID NO: 251 - protein, 7 aa, Artificial Sequence
  Synthetic sequence (A2 KRAS TCR06 - CDRalpha2)
IFSNMDM

SEQ ID NO: 252 - protein, 12 aa, Artificial Sequence
  Synthetic sequence (A2 KRAS TCR06 - CDRalpha3)
CAEIDGTDKLIF

SEQ ID NO: 253 - protein, 5 aa, Artificial Sequence
  Synthetic sequence (A2 KRAS TCR07 - CDRbeta1)
SGHAT

SEQ ID NO: 254 - protein, 6 aa, Artificial Sequence
  Synthetic sequence (A2 KRAS TCR07 - CDRbeta2)
FQDESV

SEQ ID NO: 255 - protein, 13 aa, Artificial Sequence
  Synthetic sequence (A2 KRAS TCR07 - CDRbeta3)
CASSPTGEGEQYF

SEQ ID NO: 256 - protein, 6 aa, Artificial Sequence
  Synthetic sequence (A2 KRAS TCR07 - CDRalpha1)
DSSSTY

SEQ ID NO: 257 - protein, 7 aa, Artificial Sequence
  Synthetic sequence (A2 KRAS TCR07 - CDRalpha2)
IFSNMDM

SEQ ID NO: 258 - protein, 13 aa, Artificial Sequence
  Synthetic sequence (A2 KRAS TCR07 - CDRalpha3)
CAEIEDNTDKLIF

SEQ ID NO: 259 - protein, 5 aa, Artificial Sequence
  Synthetic sequence (A2 KRAS TCR08 - CDRbeta1)
MDHEN

SEQ ID NO: 260 - protein, 6 aa, Artificial Sequence
  Synthetic sequence (A2 KRAS TCR08 - CDRbeta2)
SYDVKM

SEQ ID NO: 261 - protein, 13 aa, Artificial Sequence
  Synthetic sequence (A2 KRAS TCR08 - CDRbeta3)
CAIEPPTGNEQYF

SEQ ID NO: 262 - protein, 6 aa, Artificial Sequence
  Synthetic sequence (A2 KRAS TCR08 - CDRalpha1)
DSSSTY

SEQ ID NO: 263 - protein, 7 aa, Artificial Sequence
  Synthetic sequence (A2 KRAS TCR08 - CDRalpha2)
IFSNMDM

SEQ ID NO: 264 - protein, 14 aa, Artificial Sequence
  Synthetic sequence (A2 KRAS TCR08 - CDRalpha3)
CAERIDSGNTPLVF

SEQ ID NO: 265 - protein, 5 aa, Artificial Sequence
  Synthetic sequence (A2 KRAS TCR09 - CDRbeta1)
MNHEY

SEQ ID NO: 266 - protein, 6 aa, Artificial Sequence
  Synthetic sequence (A2 KRAS TCR09 - CDRbeta2)
SMNVEV

SEQ ID NO: 267 - protein, 14 aa, Artificial Sequence
  Synthetic sequence (A2 KRAS TCR09 - CDRbeta3)
CASSQAGLGNEQFF

SEQ ID NO: 268 - protein, 6 aa, Artificial Sequence
  Synthetic sequence (A2 KRAS TCR09 - CDRalpha1)
NSASDY

SEQ ID NO: 269 - protein, 7 aa, Artificial Sequence
  Synthetic sequence (A2 KRAS TCR09 - CDRalpha2)
IRSNMDK

SEQ ID NO: 270 - protein, 12 aa, Artificial Sequence
  Synthetic sequence (A2 KRAS TCR09 - CDRalpha3)
CAEIFNDYKLSF

SEQ ID NO: 271 - protein, 5 aa, Artificial Sequence
  Synthetic sequence (A2 KRAS TCR10 - CDRbeta1)
MNHEY

SEQ ID NO: 272 - protein, 6 aa, Artificial Sequence
  Synthetic sequence (A2 KRAS TCR10 - CDRbeta2)
SVGAGI

SEQ ID NO: 273 - protein, 13 aa, Artificial Sequence
  Synthetic sequence (A2 KRAS TCR10 - CDRbeta3)
CASSRTGADGYTF

SEQ ID NO: 274 - protein, 6 aa, Artificial Sequence
  Synthetic sequence (A2 KRAS TCR10 - CDRalpha1)
YGATPY

SEQ ID NO: 275 - protein, 8 aa, Artificial Sequence
  Synthetic sequence (A2 KRAS TCR10 - CDRalpha2)
YFSGDTLV

SEQ ID NO: 276 - protein, 13 aa, Artificial Sequence
  Synthetic sequence (A2 KRAS TCR10 - CDRalpha3)
CAVGSDSNYQLIW

SEQ ID NO: 277 - protein, 5 aa, Artificial Sequence
  Synthetic sequence (A2 KRAS TCR11 - CDRbeta1)
MGHRA

SEQ ID NO: 278 - protein, 6 aa, Artificial Sequence
  Synthetic sequence (A2 KRAS TCR11 - CDRbeta2)
YSYEKL

SEQ ID NO: 279 - protein, 15 aa, Artificial Sequence
  Synthetic sequence (A2 KRAS TCR11 - CDRbeta3)
CASSQDLGTVYEQYF

SEQ ID NO: 280 - protein, 6 aa, Artificial Sequence
  Synthetic sequence (A2 KRAS TCR11 - CDRalpha1)
NSMFDY

SEQ ID NO: 281 - protein, 7 aa, Artificial Sequence
  Synthetic sequence (A2 KRAS TCR11 - CDRalpha2)
ISSIKDK

SEQ ID NO: 282 - protein, 15 aa, Artificial Sequence
  Synthetic sequence (A2 KRAS TCR11 - CDRalpha3)
CAAISLTSGTYKYIF

SEQ ID NO: 283 - protein, 5 aa, Artificial Sequence
  Synthetic sequence (A2 KRAS TCR12 - CDRbeta1)
MDHEN

SEQ ID NO: 284 - protein, 6 aa, Artificial Sequence
  Synthetic sequence (A2 KRAS TCR12 - CDRbeta2)
SYDVKM

SEQ ID NO: 285 - protein, 15 aa, Artificial Sequence
  Synthetic sequence (A2 KRAS TCR12 - CDRbeta3)
CASSLQVSGVAGYTF

SEQ ID NO: 286 - protein, 6 aa, Artificial Sequence
  Synthetic sequence (A2 KRAS TCR12 - CDRalpha1)
SSVSVY

SEQ ID NO: 287 - protein, 8 aa, Artificial Sequence
  Synthetic sequence (A2 KRAS TCR12 - CDRalpha2)
YLSGSTLV

SEQ ID NO: 288 - protein, 11 aa, Artificial Sequence
  Synthetic sequence (A2 KRAS TCR12 - CDRalpha3)
CAVTRDDKIIF

SEQ ID NO: 289 - protein, 5 aa, Artificial Sequence
  Synthetic sequence (A2 KRAS TCR13 - CDRbeta1)
SGHAT

SEQ ID NO: 290 - protein, 6 aa, Artificial Sequence
  Synthetic sequence (A2 KRAS TCR13 - CDRbeta2)
FQDESV

SEQ ID NO: 291 - protein, 13 aa, Artificial Sequence
  Synthetic sequence (A2 KRAS TCR13 - CDRbeta3)
CASSPTGEGEQYF

SEQ ID NO: 292 - protein, 6 aa, Artificial Sequence
  Synthetic sequence (A2 KRAS TCR13 - CDRalpha1)
DSSSTY

SEQ ID NO: 293 - protein, 7 aa, Artificial Sequence
  Synthetic sequence (A2 KRAS TCR13 - CDRalpha2)
IFSNMDM

SEQ ID NO: 294 - protein, 13 aa, Artificial Sequence
  Synthetic sequence (A2 KRAS TCR13 - CDRalpha3)
CAEIEDNTDKLIF

SEQ ID NO: 295 - protein, 5 aa, Artificial Sequence
  Synthetic sequence (A2 KRAS TCR14 - CDRbeta1)
MGHRA

SEQ ID NO: 296 - protein, 6 aa, Artificial Sequence
  Synthetic sequence (A2 KRAS TCR14 - CDRbeta2)
YSYEKL

SEQ ID NO: 297 - protein, 15 aa, Artificial Sequence
  Synthetic sequence (A2 KRAS TCR14 - CDRbeta3)
CASSQDLGTVYEQYF

SEQ ID NO: 298 - protein, 6 aa, Artificial Sequence
  Synthetic sequence (A2 KRAS TCR14 - CDRalpha1)
NSMFDY

SEQ ID NO: 299 - protein, 7 aa, Artificial Sequence
  Synthetic sequence (A2 KRAS TCR14 - CDRalpha2)
ISSIKDK

SEQ ID NO: 300 - protein, 15 aa, Artificial Sequence
  Synthetic sequence (A2 KRAS TCR14 - CDRalpha3)
CAAISLTSGTYKYIF

SEQ ID NO: 301 - protein, 5 aa, Artificial Sequence
  Synthetic sequence (A2 KRAS TCR15  - CDRbeta1)
SGHAT

SEQ ID NO: 302 - protein, 6 aa, Artificial Sequence
  Synthetic sequence (A2 KRAS TCR15 - CDRbeta2)
FQNNGV

SEQ ID NO: 303 - protein, 13 aa, Artificial Sequence
  Synthetic sequence (A2 KRAS TCR15 - CDRbeta3)
CASSLPSGNEQFF

SEQ ID NO: 304 - protein, 6 aa, Artificial Sequence
  Synthetic sequence (A2 KRAS TCR15 - CDRalpha1)
DSSSTY

SEQ ID NO: 305 - protein, 7 aa, Artificial Sequence
  Synthetic sequence (A2 KRAS TCR15 - CDRalpha2)
IFSNMDM

SEQ ID NO: 306 - protein, 12 aa, Artificial Sequence
  Synthetic sequence  (A2 KRAS TCR15 - CDRalpha3)
CAEMMDTDKLIF

SEQ ID NO: 307 - protein, 5 aa, Artificial Sequence
  Synthetic sequence  (A2 KRAS TCR16 - CDRbeta1)
KGHDR

SEQ ID NO: 308 - protein, 6 aa, Artificial Sequence
  Synthetic sequence  (A2 KRAS TCR16 - CDRbeta2)
SFDVKD

SEQ ID NO: 309 - protein, 13 aa, Artificial Sequence
  Synthetic sequence  (A2 KRAS TCR16 - CDRbeta3)
CATSGQGGDEQFF

SEQ ID NO: 310 - protein, 6 aa, Artificial Sequence
  Synthetic sequence  (A2 KRAS TCR16 - CDRalpha1)
DSSSTY

SEQ ID NO: 311 - protein, 7 aa, Artificial Sequence
  Synthetic sequence (A2 KRAS TCR16 - CDRalpha2)
IFSNMDM

SEQ ID NO: 312 - protein, 14 aa, Artificial Sequence
  Synthetic sequence (A2 KRAS TCR16 - CDRalpha3)
CAEIVDNQGGKLIF

SEQ ID NO: 313 - protein, 6 aa, Artificial Sequence
  Synthetic sequence (A2 KRAS TCR17 - CDRbeta1)
DFQATT

SEQ ID NO: 314 - protein, 7 aa, Artificial Sequence
  Synthetic sequence (A2 KRAS TCR17 - CDRbeta2)
SNEGSKA

SEQ ID NO: 315 - protein, 15 aa, Artificial Sequence
  Synthetic sequence (A2 KRAS TCR17 - CDRbeta3)
CSADRLAGGEETQYF

SEQ ID NO: 316 - protein, 5 aa, Artificial Sequence
  Synthetic sequence (A2 KRAS TCR17 - CDRalpha1)
SVFSS

SEQ ID NO: 317 - protein, 7 aa, Artificial Sequence
  Synthetic sequence (A2 KRAS TCR17 - CDRalpha2)
VVTGGEV

SEQ ID NO: 318 - protein, 11 aa, Artificial Sequence
  Synthetic sequence (A2 KRAS TCR17 - CDRalpha3)
CAGSNDYKLSF

SEQ ID NO: 319 - protein, 5 aa, Artificial Sequence
  Synthetic sequence (A2 KRAS TCR18 - CDRbeta1)
MDHEN

SEQ ID NO: 320 - protein, 6 aa, Artificial Sequence
  Synthetic sequence (A2 KRAS TCR18 - CDRbeta2)
SYDVKM

SEQ ID NO: 321 - protein, 13 aa, Artificial Sequence
  Synthetic sequence (A2 KRAS TCR18 - CDRbeta3)
CASRGLSTDTQYF

SEQ ID NO: 322 - protein, 6 aa, Artificial Sequence
  Synthetic sequence (A2 KRAS TCR18 - CDRalpha1)
DSSSTY

SEQ ID NO: 323 - protein, 7 aa, Artificial Sequence
  Synthetic sequence (A2 KRAS TCR18 - CDRalpha2)
IFSNMDM

SEQ ID NO: 324 - protein, 14 aa, Artificial Sequence
  Synthetic sequence (A2 KRAS TCR18 - CDRalpha3)
CAVLLDNQGGKLIF

SEQ ID NO: 325 - protein, 5 aa, Artificial Sequence
  Synthetic sequence (A2 KRAS TCR19 - CDRbeta1)
LNHDA

SEQ ID NO: 326 - protein, 6 aa, Artificial Sequence
  Synthetic sequence (A2 KRAS TCR19 - CDRbeta2)
SQIVND

SEQ ID NO: 327 - protein, 12 aa, Artificial Sequence
  Synthetic sequence (A2 KRAS TCR19 - CDRbeta3)
CASRSDRNEQFF

SEQ ID NO: 328 - protein, 6 aa, Artificial Sequence
  Synthetic sequence (A2 KRAS TCR19 - CDRalpha1)
YGGTVN

SEQ ID NO: 329 - protein, 8 aa, Artificial Sequence
  Synthetic sequence (A2 KRAS TCR19 - CDRalpha2)
YFSGDPLV

SEQ ID NO: 330-339 - skipped (10 entries)

SEQ ID NO: 340 - protein, 13 aa, Artificial Sequence
  Synthetic sequence (A2 KRAS TCR19 - CDRalpha3)
CAVNDPSDYKLSF

SEQ ID NO: 341 - DNA, 813 bp, Artificial Sequence
  Synthetic sequence (A2 KRAS TCR01 - TCRalpha
atggaaactctcctgggagtgtctttggtgattctatggcttcaactggctagggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacgacgactacaagctcagctttggagccggaaccacagtaactgtaagagcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 342 - protein, 270 aa, Artificial Sequence
  Synthetic sequence (A2 KRAS TCR01 - TCRalpha)
METLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDDDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 343 - protein, 110 aa, Artificial Sequence
  Synthetic sequence (A2 KRAS TCR01 - TCR Valpha)
SQQGEEDPQALSIQEGENATMNCSYKTSINNLQWYRQNSGRGLVHLILIRSNEREKHSGRLRVTLDTSKKSSSLLITASRAADTASYFCATDDDYKLSFGAGTTVTVRAN

SEQ ID NO: 344 - DNA, 942 bp, Artificial Sequence
  Synthetic sequence (A2 KRAS TCR01 - TCRbeta)
atgggtcctgggcttctccactggatggccctttgtctccttggaacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacgcagccatgtacctgtgtgccaccagcagcctgggacaggggtaccaagagacccagtacttcgggccaggcacgcggctcctggtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 345 - protein, 313 aa, Artificial Sequence
  Synthetic sequence (A2 KRAS TCR01 - TCRbeta)
MGPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSSLGQGYQETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 346 - protein, 115 aa, Artificial Sequence
  Synthetic sequence  (A2 KRAS TCR01 - TCR Vbeta)
DAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSSLGQGYQETQYFGPGTRLLVL

SEQ ID NO: 347 - DNA, 1355 bp, Artificial Sequence
  Synthetic sequence  (A2 KRAS TCR01 - TCRbeta-P2A-TCRalpha fragment)
cccagtttggcaaaccagtgacactgagctgttctcagaccctgaaccacaacgtgatgtactggtaccagcagaagtcttctcaggcccctaagctgctgttccactactacgacaaggacttcaacaacgaggccgatacccctgacaatttccagagcaggaggcccaataccagcttctgtttcctggacattagaagccctggactgggagatgctgccatgtacctgtgtgccacatcttctctgggacagggatatcaagaaacccagtacttcggaccaggcaccagactgttagtgctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccaccgatgatgactacaagctgtcttttggagccggaaccaccgtgacagtgagggccaatatccagaatcctgatcctgctgtgtaccagctgcgggacagcaagagcagcgac

SEQ ID NO: 348 - protein, 495 aa, Artificial Sequence
  Synthetic sequence  (A2 KRAS TCR01 - TCRbeta-P2A-TCRalpha fragment)
QKSPQPLTRRATMGPGLLHWMALCLLGTGHGDAMVIQNPRYQVTQFGKPVTLSCSQTLNHNVMYWYQQKSSQAPKLLFHYYDKDFNNEADTPDNFQSRRPNTSFCFLDIRSPGLGDAAMYLCATSSLGQGYQETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDDDYKLSFGAGTTVTVRANIQNPDPAVYQLRDSKSSD

SEQ ID NO: 349 - DNA, 822 bp, Artificial Sequence
  Synthetic sequence  (A2 KRAS TCR02 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagatagaggataacaccgacaagctcatctttgggactgggaccagattacaagtctttccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 350 - protein, 273 aa, Artificial Sequence
  Synthetic sequence  (A2 KRAS TCR02 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIEDNTDKLIFGTGTRLQVFPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 351 - protein, 112 aa, Artificial Sequence
  Synthetic sequence  (A2 KRAS TCR02 - TCR Valpha
GEDVEQSLFLSVREGDSSVINCTYTDSSSTYLYWYKQEPGAGLQLLTYIFSNMDMKQDQRLTVLLNKKDKHLSLRIADTQTGDSAIYFCAEIEDNTDKLIFGTGTRLQVFPN

SEQ ID NO: 352 - DNA, 936 bp, Artificial Sequence
  Synthetic sequence  (A2 KRAS TCR02 - TCRbeta)
atgagcaccaggcttctctgctggatggccctctgtctcctgggggcagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagccccacaggggaaggcgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 353 - protein, 311 aa, Artificial Sequence
  Synthetic sequence  (A2 KRAS TCR02 - TCRbeta)
MSTRLLCWMALCLLGAELSEAEVAQSPRYKITEKSQAVAFWCDPISGHATLYWYRQILGQGPELLVQFQDESVVDDSQLPKDRFSAERLKGVDSTLKIQPAELGDSAMYLCASSPTGEGEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 354 - protein, 113 aa, Artificial Sequence
  Synthetic sequence  (A2 KRAS TCR02 - TCR Vbeta)
EAEVAQSPRYKITEKSQAVAFWCDPISGHATLYWYRQILGQGPELLVQFQDESVVDDSQLPKDRFSAERLKGVDSTLKIQPAELGDSAMYLCASSPTGEGEQYFGPGTRLTVT

SEQ ID NO: 355 - DNA, 1493 bp, Artificial Sequence
  Synthetic sequence  (A2 KRAS TCR02 - TCRbeta-P2A-TCRalpha fragment)
ctcaataaaagagcccacaacccctcactcggcgcgccaccatgagcaccagactcctttgctggatggctttgtgtctgcttggagctgagctgtctgaagctgaagttgcccagtctcccagatacaagatcaccgagaaatctcaggctgtggccttctggtgtgaccctatttctggacacgccaccctgtactggtataggcaaattctgggacaaggccctgaactgctggtgcaatttcaggatgagagcgtggtggacgattctcaactgcctaaggacaggttttctgccgagcggctgaaaggagttgatagcaccctgaagatccaacctgctgaactgggcgattctgctatgtacctgtgcgcctcttctcctacaggagagggagaacagtattttggacctggcaccagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagatcgaggacaacaccgacaagctgatctttggaaccggaacaagactgcaggtgttccccaacatccagaatcccgatcctgccgtgtaccagctgcgggacagcaagagcagcgac

SEQ ID NO: 356 - protein, 496 aa, Artificial Sequence
  Synthetic sequence (A2 KRAS TCR02 - TCRbeta-P2A-TCRalpha fragment
QKSPQPLTRRATMSTRLLCWMALCLLGAELSEAEVAQSPRYKITEKSQAVAFWCDPISGHATLYWYRQILGQGPELLVQFQDESVVDDSQLPKDRFSAERLKGVDSTLKIQPAELGDSAMYLCASSPTGEGEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIEDNTDKLIFGTGTRLQVFPNIQNPDPAVYQLRDSKSSD

SEQ ID NO: 357 - DNA, 819 bp, Artificial Sequence
  Synthetic sequence (A2 KRAS TCR03 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagaggaccgacaccgacaagctcatctttgggactgggaccagattacaagtctttccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 358 - protein, 272 aa, Artificial Sequence
  Synthetic sequence (A2 KRAS TCR03 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAERTDTDKLIFGTGTRLQVFPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 359 - protein, 111 aa, Artificial Sequence
  Synthetic sequence (A2 KRAS TCR03 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAERTDTDKLIFGTGTRLQVFPN

SEQ ID NO: 360 - DNA, 936 bp, Artificial Sequence
  Synthetic sequence (A2 KRAS TCR03 - TCRbeta)
atgggcaccaggctcctctgctgggcagccctgtgcctcctgggggcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagccccctagcggcgaatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 361 - protein, 311 aa, Artificial Sequence
  Synthetic sequence (A2 KRAS TCR03 - TCRbeta)
MGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSPLAANEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 362 - protein, 113 aa, Artificial Sequence
  Synthetic sequence (A2 KRAS TCR03 - TCR Vbeta)
GAGVSQTPSNKVTEKGKYVELRCDPISGHTALYWYRQSLGQGPEFLIYFQGTGAADDSGLPNDRFFAVRPEGSVSTLKIQRTERGDSAVYLCASSPLAANEQFFGPGTRLTVL

SEQ ID NO: 363 - DNA, 1490 bp, Artificial Sequence
  Synthetic sequence  (A2 KRAS TCR03 - TCRbeta-P2A-TCRalpha fragment
ctcaataaaagagcccacaacccctcactcggcgcgccaccatgggcacaagacttctctgttgggctgctctttgtctgcttggagccgatcatacaggagctggagttagccagacacctagcaataaggtgaccgaaaagggcaagtacgtggagctgagatgcgaccctatttctggccatacagccctgtactggtacagacaatctctgggacaaggacccgagttcctgatctactttcagggaacaggagccgccgatgattctggacttcctaacgacaggttcttcgccgtgagaccagaaggatctgtttctaccctgaagatccagaggaccgagagaggcgattctgctgtgtacctgtgtgcctcttctcctttagctgccaatgagcagttctttggccctggcacaagactgacagtgctggaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagagaaccgacaccgacaagctgatctttggaacaggcacaagactgcaggtgttccccaatatccagaatcccgatcctgccgtgtaccagctgcgggacagcaagagcagcgac

SEQ ID NO: 364 - protein, 495 aa, Artificial Sequence
  Synthetic sequence  (A2 KRAS TCR03 - TCRbeta-P2A-TCRalpha fragment)
QKSPQPLTRRATMGTRLLCWAALCLLGADHTGAGVSQTPSNKVTEKGKYVELRCDPISGHTALYWYRQSLGQGPEFLIYFQGTGAADDSGLPNDRFFAVRPEGSVSTLKIQRTERGDSAVYLCASSPLAANEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAERTDTDKLIFGTGTRLQVFPNIQNPDPAVYQLRDSKSSD

SEQ ID NO: 365 - DNA, 825 bp, Artificial Sequence
  Synthetic sequence  (A2 KRAS TCR04 - TCRalpha)
atgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgatggatagcagctataaattgatcttcgggagtgggaccagactgctggtcaggcctgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 366 - protein, 274 aa, Artificial Sequence
  Synthetic sequence (A2 KRAS TCR04 - TCRalpha)
MLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALMDSSYKLIFGSGTRLLVRPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 367 - protein, 114 aa, Artificial Sequence
  Synthetic sequence (A2 KRAS TCR04 - TCR Valpha)
AQKVTQAQTEISVVEKEDVTLDCVYETRDTTYYLFWYKQPPSGELVFLIRRNSFDEQNEISGRYSWNFQKSTSSFNFTITASQVVDSAVYFCALMDSSYKLIFGSGTRLLVRPD

SEQ ID NO: 368 - DNA, 930 bp, Artificial Sequence
  Synthetic sequence (A2 KRAS TCR04 - TCRbeta)
atgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgcttttcttagcggatccgcagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 369 - protein, 309 aa, Artificial Sequence
  Synthetic sequence (A2 KRAS TCR04 - TCRbeta)
MLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAFLSGSADTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 370 - protein, 116 aa, Artificial Sequence
  Synthetic sequence (A2 KRAS TCR04 - TCR Vbeta)
GAVVSQHPSWVICKSGTSVKIECRSLDFQATTMFWYRQFPKQSLMLMATSNEGSKATYEQGVEKDKFLINHASLTLSTLTVTSAHPEDSSFYICSAFLSGSADTQYFGPGTRLTVL

SEQ ID NO: 371 - DNA, 1490 bp, Artificial Sequence
  Synthetic sequence (A2 KRAS TCR04 - TCRbeta-P2A-TCRalpha fragment)
ctcaataaaagagcccacaacccctcactcggcgcgccaccatgctgcttcttctcctccttctcggacctggatctggattaggagctgtggtttctcagcacccttcttgggtgatctgtaaaagcggcacaagcgtgaagatcgagtgcagaagcctggactttcaggccacaaccatgttctggtataggcagttccccaagcagtctctgatgctgatggccacctctaatgagggctctaaggccacatatgaacagggagtggagaaggacaagttcctgatcaaccacgcctctctgaccctgtctaccctgacagttacatctgcccaccctgaggatagcagcttttacatctgtagcgccttcctgtctggaagcgccgatacacagtactttggacctggcaccagactgacagtgttagaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgttgaccgcttctctcttacgtgccgtgattgccagcatctgtgtggtgtcttctatggcccagaaggttacacaggctcagacagagatcagcgttgtggagaaggaggatgtgaccctggattgcgtgtacgagacaagagataccacctactacctgttctggtacaagcagcctccttctggcgaactggtgttcctgatccggagaaacagctttgatgagcagaacgagattagcggcaggtatagctggaacttccagaagagcaccagcagcttcaacttcaccatcacagcctctcaggtggtggattctgccgtgtacttttgtgccctgatggacagcagctacaagctgatctttggaagcggcaccagactgctggtgagacctgatatccagaatcctgatcctgccgtgtaccagctgcgggacagcaagagcagcgac

SEQ ID NO: 372 - protein, 495 aa, Artificial Sequence
  Synthetic sequence (A2 KRAS TCR04 - TCRbeta-P2A-TCRalpha fragment)
QKSPQPLTRRATMLLLLLLLGPGSGLGAVVSQHPSWVICKSGTSVKIECRSLDFQATTMFWYRQFPKQSLMLMATSNEGSKATYEQGVEKDKFLINHASLTLSTLTVTSAHPEDSSFYICSAFLSGSADTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLTASLLRAVIASICVVSSMAQKVTQAQTEISVVEKEDVTLDCVYETRDTTYYLFWYKQPPSGELVFLIRRNSFDEQNEISGRYSWNFQKSTSSFNFTITASQVVDSAVYFCALMDSSYKLIFGSGTRLLVRPDIQNPDPAVYQLRDSKSSD

SEQ ID NO: 373 - DNA, 828 bp, Artificial Sequence
  Synthetic sequence (A2 KRAS TCR05 - TCRalpha)
atgctcctggagcttatcccactgctggggatacattttgtcctgagaactgccagagcccagtcagtgacccagcctgacatccacatcactgtctctgaaggagcctcactggagttgagatgtaactattcctatggggcaacaccttatctcttctggtatgtccagtcccccggccaaggcctccagctgctcctgaagtacttttcaggagacactctggttcaaggcattaaaggctttgaggctgaatttaagaggagtcaatcttccttcaatctgaggaaaccctctgtgcattggagtgatgctgctgagtacttctgtgctgtgggtgatgagaacacaggctttcagaaacttgtatttggaactggcacccgacttctggtcagtccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 374 - protein, 275 aa, Artificial Sequence
  Synthetic sequence (A2 KRAS TCR05 - TCRalpha)
MLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVGDENTGFQKLVFGTGTRLLVSPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 375 - protein, 116 aa, Artificial Sequence
  Synthetic sequence (A2 KRAS TCR05 - TCR Valpha)
AQSVTQPDIHITVSEGASLELRCNYSYGATPYLFWYVQSPGQGLQLLLKYFSGDTLVQGIKGFEAEFKRSQSSFNLRKPSVHWSDAAEYFCAVGDENTGFQKLVFGTGTRLLVSPN

SEQ ID NO: 376 - DNA, 933 bp, Artificial Sequence
  Synthetic sequence (A2 KRAS TCR05 - TCRbeta)
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcgcccttcgggggacctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 377 - protein, 310 aa, Artificial Sequence
  Synthetic sequence (A2 KRAS TCR05 - TCRbeta)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASALRGTYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 378 - protein, 112 aa, Artificial Sequence
  Synthetic sequence (A2 KRAS TCR05 - TCR Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCASALRGTYEQYFGPGTRLTVT

SEQ ID NO: 379 - DNA, 1496 bp, Artificial Sequence
  Synthetic sequence (A2 KRAS TCR05 - TCRbeta-P2A-TCRalpha)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcttctgctctgagaggcacatatgagcagtacttcggccctggaacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgctgctggaactgatacccctactgggcatccactttgtgctgagaacagctagagcccaatctgtgacacagcccgatatccacattaccgtgagcgaaggagcttctctggaactgagatgcaactacagctatggcgccaccccttaccttttctggtacgtgcagtctcctggacagggattacaactgctgctgaagtacttctccggcgatacactggttcagggcattaagggctttgaggccgagttcaagagaagccagagcagctttaacctgagaaagcctagcgtgcactggtctgatgctgccgagtacttttgtgctgtgggcgacgagaataccggatttcagaaactggtgttcggaacaggcaccaggctgttagttagccccaacatccagaaccctgatcctgctgtgtaccagctgcgggacagcaagagcagcgac

SEQ ID NO: 380 - protein, 497 aa, Artificial Sequence
  Synthetic sequence (A2 KRAS TCR05 - TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASALRGTYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVGDENTGFQKLVFGTGTRLLVSPNIQNPDPAVYQLRDSKSSD

SEQ ID NO: 381 - DNA, 819 bp, Artificial Sequence
  Synthetic sequence (A2 KRAS TCR06 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagatcgatggcaccgacaagctcatctttgggactgggaccagattacaagtctttccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 382 - protein, 272 aa, Artificial Sequence
  Synthetic sequence (A2 KRAS TCR06 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIDGTDKLIFGTGTRLQVFPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 383 - protein, 111 aa, Artificial Sequence
  Synthetic sequence (A2 KRAS TCR06 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAEIDGTDKLIFGTGTRLQVFPN

SEQ ID NO: 384 - DNA, 936 bp, Artificial Sequence
  Synthetic sequence (A2 KRAS TCR06 - TCRbeta)
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttaggggacaggatatacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 385 - protein, 311 aa, Artificial Sequence
  Synthetic sequence (A2 KRAS TCR06 - TCRbeta)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLGDRIYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 386 - protein, 113 aa, Artificial Sequence
  Synthetic sequence (A2 KRAS TCR06 - TCR Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCASSLGDRIYEQYFGPGTRLTVT

SEQ ID NO: 387 - DNA, 1490 bp, Artificial Sequence
  Synthetic sequence (A2 KRAS TCR06 - TCRbeta-P2A-TCRalpha fragment)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctcttctctgggagacaggatttatgagcagtacttcggaccaggcacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagatcgatggcaccgacaagctgatctttggaacaggcacaagactgcaggtgttccccaatatccagaatcccgatcctgccgtgtaccagctgcgggacagcaagagcagcgac

SEQ ID NO: 388 - protein, 495 aa, Artificial Sequence
  Synthetic sequence (A2 KRAS TCR06 - TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLGDRIYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIDGTDKLIFGTGTRLQVFPNIQNPDPAVYQLRDSKSSD

SEQ ID NO: 389 - DNA, 822 bp, Artificial Sequence; identical to SEQ ID NO: 349
  Synthetic sequence (A2 KRAS TCR07 - TCRalpha)

SEQ ID NO: 390 - protein, 273 aa, Artificial Sequence; identical to SEQ ID NO: 350
  Synthetic sequence (A2 KRAS TCR07 - TCRalpha)

SEQ ID NO: 391 - protein, 112 aa, Artificial Sequence; identical to SEQ ID NO: 351
  Synthetic sequence (A2 KRAS TCR07 - TCR Valpha)

SEQ ID NO: 392 - DNA, 936 bp, Artificial Sequence; identical to SEQ ID NO: 352
  Synthetic sequence (A2 KRAS TCR07 - TCRbeta)

SEQ ID NO: 393 - protein, 311 aa, Artificial Sequence; identical to SEQ ID NO: 353
  Synthetic sequence (A2 KRAS TCR07 - TCRbeta)

SEQ ID NO: 394 - protein, 113 aa, Artificial Sequence; identical to SEQ ID NO: 354
  Synthetic sequence (A2 KRAS TCR07 - TCR Vbeta)

SEQ ID NO: 395 - DNA, 1493 bp, Artificial Sequence; identical to SEQ ID NO: 355
  Synthetic sequence (A2 KRAS TCR07 - TCRbeta-P2A-TCRalpha fragment)

SEQ ID NO: 396 - protein, 496 aa, Artificial Sequence; identical to SEQ ID NO: 356
  Synthetic sequence (A2 KRAS TCR07 - TCRbeta-P2A-TCRalpha fragment)

SEQ ID NO: 397 - DNA, 825 bp, Artificial Sequence
  Synthetic sequence (A2 KRAS TCR08 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagaatagattcaggaaacacacctcttgtctttggaaagggcacaagactttctgtgattgcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 398 - protein, 274 aa, Artificial Sequence
  Synthetic sequence (A2 KRAS TCR08 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAERIDSGNTPLVFGKGTRLSVIANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 399 - protein, 113 aa, Artificial Sequence
  Synthetic sequence (A2 KRAS TCR08 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAERIDSGNTPLVFGKGTRLSVIAN

SEQ ID NO: 400 - DNA, 933 bp, Artificial Sequence
  Synthetic sequence (A2 KRAS TCR08 - TCRbeta)
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccatcgaacccccgacagggaacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 401 - protein, 310 aa, Artificial Sequence
  Synthetic sequence (A2 KRAS TCR08 - TCRbeta)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCAIEPPTGNEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 402 - protein, 112 aa, Artificial Sequence
  Synthetic sequence (A2 KRAS TCR08 - TCR Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCAIEPPTGNEQYFGPGTRLTVT

SEQ ID NO: 403 - DNA, 1493 bp, Artificial Sequence
  Synthetic sequence (A2 KRAS TCR08 - TCRbeta-P2A-TCRalpha fragment)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgccattgaacctcctaccggcaatgagcagtatttcggacctggaacaagactgaccgtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagagaatcgatagcggcaacacacctctggtgtttggaaagggcacaaggctgtctgtgattgccaacatccagaatcccgatcctgctgtgtaccagctgcgggacagcaagagcagcgac

SEQ ID NO: 404 - protein, 496 aa, Artificial Sequence
  Synthetic sequence (A2 KRAS TCR08 - TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCAIEPPTGNEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAERIDSGNTPLVFGKGTRLSVIANIQNPDPAVYQLRDSKSSD

SEQ ID NO: 405 - DNA, 819 bp, Artificial Sequence
  Synthetic sequence (A2 KRAS TCR09 - TCRalpha)
atggcaggcattcgagctttatttatgtacttgtggctgcagctggactgggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaaacatctctctctgcaaattgcagctactcaacctggagactcagctgtctacttttgtgcagagatttttaacgactacaagctcagctttggagccggaaccacagtaactgtaagagcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 406 - protein, 272 aa, Artificial Sequence
  Synthetic sequence (A2 KRAS TCR09 - TCRalpha)
MAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEIFNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 407 - protein, 112 aa, Artificial Sequence
  Synthetic sequence (A2 KRAS TCR09 - TCR Valpha)
GESVGLHLPTLSVQEGDNSIINCAYSNSASDYFIWYKQESGKGPQFIIDIRSNMDKRQGQRVTVLLNKTVKHLSLQIAATQPGDSAVYFCAEIFNDYKLSFGAGTTVTVRAN

SEQ ID NO: 408 - DNA, 936 bp, Artificial Sequence
  Synthetic sequence (A2 KRAS TCR09 - TCRbeta)
atgggcccccagctccttggctatgtggtcctttgccttctaggagcaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtcaagcgggactaggcaatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 409 - protein, 311 aa, Artificial Sequence
  Synthetic sequence (A2 KRAS TCR09 - TCRbeta)
MGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSQAGLGNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 410 - protein, 113 aa, Artificial Sequence
  Synthetic sequence (A2 KRAS TCR09 - TCR Vbeta)
EAQVTQNPRYLITVTGKKLTVTCSQNMNHEYMSWYRQDPGLGLRQIYYSMNVEVTDKGDVPEGYKVSRKEKRNFPLILESPSPNQTSLYFCASSQAGLGNEQFFGPGTRLTVL

SEQ ID NO: 411 - DNA, 1490 bp, Artificial Sequence
  Synthetic sequence (A2 KRAS TCR09 - TCRbeta-P2A-TCRalpha fragment)
ctcaataaaagagcccacaacccctcactcggcgcgccaccatgggacctcagcttcttggatacgttgtgctgtgtctgcttggagctggacctcttgaagctcaggttacccagaaccccagatacctgattaccgtgacaggcaaaaagctgaccgtgacatgtagccagaacatgaaccacgagtacatgagctggtaccggcaggatcctggattaggcctgagacagatctactacagcatgaacgtggaggtgaccgataaaggcgacgtgcctgagggatacaaggtgagcagaaaggagaagaggaatttccccctgatcctggaaagcccaagccccaatcagacaagcctgtacttttgtgcctcttctcaagctggactgggcaatgagcagttcttcggccctggcacaagactgacagtgttagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggccggcattagagcactcttcatgtacctgtggctgcaactggattgggtgtctagaggagagtctgtgggcctgcatcttcctacactgtctgttcaggaaggcgacaatagcatcatcaattgcgcctacagcaacagcgccagcgactacttcatctggtacaagcaggagagcggaaaaggacctcagttcatcatcgacatccggagcaacatggacaagagacagggacagagagtgaccgtgctgctgaacaagacagtgaaacatctgagcctgcagattgccgctacacaacctggcgattctgccgtgtacttttgtgccgagatcttcaacgactacaagctgagctttggagccggaaccacagtgaccgtgagagccaatatccagaatcctgatcctgctgtgtaccagctgcgggacagcaagagcagcgac

SEQ ID NO: 412 - protein, 495 aa, Artificial Sequence
  Synthetic sequence (A2 KRAS TCR09 - TCRbeta-P2A-TCRalpha fragment)
QKSPQPLTRRATMGPQLLGYVVLCLLGAGPLEAQVTQNPRYLITVTGKKLTVTCSQNMNHEYMSWYRQDPGLGLRQIYYSMNVEVTDKGDVPEGYKVSRKEKRNFPLILESPSPNQTSLYFCASSQAGLGNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAEIFNDYKLSFGAGTTVTVRANIQNPDPAVYQLRDSKSSD

SEQ ID NO: 413 - DNA, 822 bp, Artificial Sequence
  Synthetic sequence (A2 KRAS TCR10 - TCRalpha)
atgctcctggagcttatcccactgctggggatacattttgtcctgagaactgccagagcccagtcagtgacccagcctgacatccacatcactgtctctgaaggagcctcactggagttgagatgtaactattcctatggggcaacaccttatctcttctggtatgtccagtcccccggccaaggcctccagctgctcctgaagtacttttcaggagacactctggttcaaggcattaaaggctttgaggctgaatttaagaggagtcaatcttccttcaatctgaggaaaccctctgtgcattggagtgatgctgctgagtacttctgtgctgtgggttcggatagcaactatcagttaatctggggcgctgggaccaagctaattataaagccagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 414 - protein, 273 aa, Artificial Sequence
  Synthetic sequence (A2 KRAS TCR10 - TCRalpha)
MLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVGSDSNYQLIWGAGTKLIIKPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 415 - protein, 114 aa, Artificial Sequence
  Synthetic sequence (A2 KRAS TCR10 - TCR Valpha)
AQSVTQPDIHITVSEGASLELRCNYSYGATPYLFWYVQSPGQGLQLLLKYFSGDTLVQGIKGFEAEFKRSQSSFNLRKPSVHWSDAAEYFCAVGSDSNYQLIWGAGTKLIIKPD

SEQ ID NO: 416 - DNA, 927 bp, Artificial Sequence
  Synthetic sequence (A2 KRAS TCR10 - TCRbeta)
atgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagtcggactggggctgatggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 417 - protein, 308 aa, Artificial Sequence
  Synthetic sequence (A2 KRAS TCR10 - TCRbeta)
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRTGADGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 418 - protein, 112 aa, Artificial Sequence
  Synthetic sequence (A2 KRAS TCR10 - TCR Vbeta)
NAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRTGADGYTFGSGTRLTVV

SEQ ID NO: 419 - DNA, 1484 bp, Artificial Sequence
  Synthetic sequence (A2 KRAS TCR10 - TCRbeta-P2A-TCRalpha fragment)
ctcaataaaagagcccacaacccctcactcggcgcgccaccatgtctatcggtctgctgtgctgtgctgctctttctctgctttgggctggacctgtgaatgctggagttacacaaacccccaagttccaagtgctgaagacaggacagagcatgaccctgcagtgtgctcaggacatgaatcacgagtacatgagctggtacagacaggatcctggaatgggcctgaggctgatccactactctgttggagccggaattacagatcagggagaagtgccaaatggctacaacgtgagcaggagcacaaccgaggacttccccttaagactgttgtctgctgctccatctcagacaagcgtgtacttttgcgccagctccagaacaggcgctgatggctatacatttggaagcggcacaagactgacagtggttgaagatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatgctgctggaactgatacccctactgggcatccactttgtgctgagaacagctagagcccaatctgtgacacagcccgatatccacattaccgtgagcgaaggagcttctctggaactgagatgcaactacagctatggcgccaccccttaccttttctggtacgtgcagtctcctggacagggattacaactgctgctgaagtacttctccggcgatacactggttcagggcattaagggctttgaggccgagttcaagagaagccagagcagctttaacctgagaaagcctagcgtgcactggtctgatgctgccgagtacttttgtgctgtgggctccgatagcaattatcagctgatctggggagccggaacaaagctgatcatcaagcctgacatccagaaccccgatcctgctgtgtaccagctgcgggacagcaagagcagcgac

SEQ ID NO: 420 - protein, 493 aa, Artificial Sequence
  Synthetic sequence (A2 KRAS TCR10 - TCRbeta-P2A-TCRalpha fragment)
QKSPQPLTRRATMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSRTGADGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVGSDSNYQLIWGAGTKLIIKPDIQNPDPAVYQLRDSKSSD

SEQ ID NO: 421 - DNA, 846 bp, Artificial Sequence
  Synthetic sequence (A2 KRAS TCR11 - TCRalpha)
atggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaatctcccttacctcaggaacctacaaatacatctttggaacaggcaccaggctgaaggttttagcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 422 - protein, 281 aa, Artificial Sequence
  Synthetic sequence (A2 KRAS TCR11 - TCRalpha)
MAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAAISLTSGTYKYIFGTGTRLKVLANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 423 - protein, 115 aa, Artificial Sequence
  Synthetic sequence (A2 KRAS TCR11 - TCR Valpha)
DQQVKQNSPSLSVQEGRISILNCDYTNSMFDYFLWYKKYPAEGPTFLISISSIKDKNEDGRFTVFLNKSAKHLSLHIVPSQPGDSAVYFCAAISLTSGTYKYIFGTGTRLKVLAN

SEQ ID NO: 424 - DNA, 939 bp, Artificial Sequence
  Synthetic sequence (A2 KRAS TCR11 - TCRbeta)
atgggctgcaggctgctctgctgtgcggttctctgtctcctgggagcagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaagatctcgggacagtctacgagcagtacttcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 425 - protein, 312 aa, Artificial Sequence
  Synthetic sequence (A2 KRAS TCR11 - TCRbeta
MGCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQDLGTVYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 426 - protein, 114 aa, Artificial Sequence
  Synthetic sequence (A2 KRAS TCR11 - TCR Vbeta)
DTEVTQTPKHLVMGMTNKKSLKCEQHMGHRAMYWYKQKAKKPPELMFVYSYEKLSINESVPSRFSPECPNSSLLNLHLHALQPEDSALYLCASSQDLGTVYEQYFGPGTRLTVT

SEQ ID NO: 427 - DNA, 1520 bp, Artificial Sequence
  Synthetic sequence (A2 KRAS TCR11 - TCRbeta-P2A-TCRalpha fragment)
ctcaataaaagagcccacaacccctcactcggcgcgccaccatgggctgtagactgttgtgttgtgctgtgctgtgtctgttgggagctgtgcctatcgatacagaggtgacccagacccctaaacatctggttatgggcatgaccaacaagaagagcctgaagtgcgagcagcacatgggccatagggccatgtattggtataagcagaaggccaagaaacctcctgagctgatgttcgtgtacagctacgagaagctgagcatcaacgagagcgtgcccagcagattttctcctgagtgccctaattctagcctgctgaatctgcacctgcatgctctgcagcctgaggattctgctctgtacctgtgtgcttcttctcaggatcttggaaccgtgtacgagcagtactttggccctggcacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggccatgttactaggagcgagcgtgctgattctgtggttacagcctgattgggtgaactctcagcagaagaacgatgatcagcaggtgaagcagaacagcccctctctgtctgtgcaggaaggcagaatcagcatcctgaattgcgattacaccaacagcatgttcgactacttcctgtggtacaagaagtaccccgccgagggccctacctttctgatcagcatctctagcatcaaggacaagaacgaagatggcagattcaccgtgttcctgaacaagagcgccaagcacctgagcctgcacattgtgccttctcaacctggagattctgccgtgtacttttgtgccgccattagcctgacaagcggcacctacaagtacatctttggcacaggcaccaggctgaaagttctggccaatatccagaatcccgatcccgccgtgtaccagctgcgggacagcaagagcagcgac

SEQ ID NO: 428 - protein, 505 aa, Artificial Sequence
  Synthetic sequence (A2 KRAS TCR11 - TCRbeta-P2A-TCRalpha fragment)
QKSPQPLTRRATMGCRLLCCAVLCLLGAVPIDTEVTQTPKHLVMGMTNKKSLKCEQHMGHRAMYWYKQKAKKPPELMFVYSYEKLSINESVPSRFSPECPNSSLLNLHLHALQPEDSALYLCASSQDLGTVYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAAISLTSGTYKYIFGTGTRLKVLANIQNPDPAVYQLRDSKSSD

SEQ ID NO: 429 - DNA, 816 bp, Artificial Sequence
  Synthetic sequence (A2 KRAS TCR12 - TCRalpha)
atgctcctgctgctcgtcccagcgttccaggtgatttttaccctgggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttgaaagcatcaacggttttgaggctgaatttaacaagagtcaaacttccttccacttgaggaaaccctcagtccatataagcgacacggctgagtacttctgtgctgtgaccagggatgacaagatcatctttggaaaagggacacgacttcatattctccccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 430 - protein, 271 aa, Artificial Sequence
  Synthetic sequence (A2 KRAS TCR12 - TCRalpha)
MLLLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVTRDDKIIFGKGTRLHILPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 431 - protein, 112 aa, Artificial Sequence
  Synthetic sequence (A2 KRAS TCR12 - TCR Valpha)
AQSVTQLDSQVPVFEEAPVELRCNYSSSVSVYLFWYVQYPNQGLQLLLKYLSGSTLVESINGFEAEFNKSQTSFHLRKPSVHISDTAEYFCAVTRDDKIIFGKGTRLHILPN

SEQ ID NO: 432 - DNA, 933 bp, Artificial Sequence
  Synthetic sequence (A2 KRAS TCR12 - TCRbeta)
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttacaggtttcaggggttgctggctacaccttcggttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 433 - protein, 310 aa, Artificial Sequence
  Synthetic sequence (A2 KRAS TCR12 - TCRbeta)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLQVSGVAGYTFGSGTRLTVVEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 434 - protein, 114 aa, Artificial Sequence
  Synthetic sequence (A2 KRAS TCR12 - TCR Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCASSLQVSGVAGYTFGSGTRLTVV

SEQ ID NO: 435 - DNA, 1484 bp, Artificial Sequence
  Synthetic sequence (A2 KRAS TCR12 - TCRbeta-P2A-TCRalpha fragment)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctcttctctgcaagtgtctggagttgctggctacacctttggatctggcacaagactgacagtggtggaggatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatgctgcttcttctcgttcctgcctttcaggtgatcttcacactgggcggcacaagagctcagtctgttacacagctggattctcaggtgcctgtgtttgaagaagctcctgtggagctgaggtgcaactactcttctagcgtgagcgtgtacctgttctggtatgtgcagtaccccaatcagggactgcagctgctgctgaaatatctgtctggctctaccctggtggaaagcatcaatggctttgaagccgagttcaacaagtcccagaccagctttcacctgaggaagccctctgtgcacatcagcgatacagccgagtacttttgtgctgtgaccagagacgacaagatcatcttcggcaagggcaccagactgcacatcctgcccaatatccagaatcctgatcctgccgtgtaccagctgcgggacagcaagagcagcgac

SEQ ID NO: 436 - protein, 493 aa, Artificial Sequence
  Synthetic sequence (A2 KRAS TCR12 - TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLQVSGVAGYTFGSGTRLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMLLLLVPAFQVIFTLGGTRAQSVTQLDSQVPVFEEAPVELRCNYSSSVSVYLFWYVQYPNQGLQLLLKYLSGSTLVESINGFEAEFNKSQTSFHLRKPSVHISDTAEYFCAVTRDDKIIFGKGTRLHILPNIQNPDPAVYQLRDSKSSD

SEQ ID NO: 437 - DNA, 822 bp, Artificial Sequence; identical to SEQ ID NO: 349
  Synthetic sequence (A2 KRAS TCR13 - TCRalpha)

SEQ ID NO: 438 - protein, 273 aa, Artificial Sequence; identical to SEQ ID NO: 350
  Synthetic sequence (A2 KRAS TCR13 - TCRalpha)

SEQ ID NO: 439 - protein, 112 aa, Artificial Sequence; identical to SEQ ID NO: 351
  Synthetic sequence (A2 KRAS TCR13 - TCR Valpha)

SEQ ID NO: 440 - DNA, 936 bp, Artificial Sequence; identical to SEQ ID NO: 352
  Synthetic sequence (A2 KRAS TCR13 - TCRbeta)

SEQ ID NO: 441 - protein, 311 aa, Artificial Sequence; identical to SEQ ID NO: 353
  Synthetic sequence (A2 KRAS TCR13 - TCRbeta)

SEQ ID NO: 442 - protein, 113 aa, Artificial Sequence; identical to SEQ ID NO: 354
  Synthetic sequence (A2 KRAS TCR13 - TCR Vbeta)

SEQ ID NO: 443 - DNA, 1493 bp, Artificial Sequence; identical to SEQ ID NO: 355
  Synthetic sequence (A2 KRAS TCR13 - TCRbeta-P2A-TCRalpha fragment)

SEQ ID NO: 444 - protein, 496 aa, Artificial Sequence; identical to SEQ ID NO: 356
  Synthetic sequence (A2 KRAS TCR13 - TCRbeta-P2A-TCRalpha fragment)

SEQ ID NO: 445 - DNA, 846 bp, Artificial Sequence; identical to SEQ ID NO: 421
  Synthetic sequence (A2 KRAS TCR14 - TCRalpha)

SEQ ID NO: 446 - protein, 281 aa, Artificial Sequence; identical to SEQ ID NO: 422
  Synthetic sequence (A2 KRAS TCR14 - TCRalpha)

SEQ ID NO: 447 - protein, 115 aa, Artificial Sequence; identical to SEQ ID NO: 423
  Synthetic sequence (A2 KRAS TCR14 - TCR Valpha)

SEQ ID NO: 448 - DNA, 939 bp, Artificial Sequence; identical to SEQ ID NO: 424
  Synthetic sequence (A2 KRAS TCR14 - TCRbeta)

SEQ ID NO: 449 - protein, 312 aa, Artificial Sequence; identical to SEQ ID NO: 425
  Synthetic sequence (A2 KRAS TCR14 - TCRbeta)

SEQ ID NO: 450 - protein, 114 aa, Artificial Sequence; identical to SEQ ID NO: 426
  Synthetic sequence (A2 KRAS TCR14 - TCR Vbeta)

SEQ ID NO: 451 - DNA, 1520 bp, Artificial Sequence; identical to SEQ ID NO: 427
  Synthetic sequence (A2 KRAS TCR14 - TCRbeta-P2A-TCRalpha fragment)

SEQ ID NO: 452 - protein, 505 aa, Artificial Sequence; identical to SEQ ID NO: 428
  Synthetic sequence (A2 KRAS TCR14 - TCRbeta-P2A-TCRalpha fragment)

SEQ ID NO: 453 - DNA, 819 bp, Artificial Sequence
  Synthetic sequence (A2 KRAS TCR15 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagatgatggacaccgacaagctcatctttgggactgggaccagattacaagtctttccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 454 - protein, 272 aa, Artificial Sequence
  Synthetic sequence (A2 KRAS TCR15 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEMMDTDKLIFGTGTRLQVFPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 455 - protein, 111 aa, Artificial Sequence
  Synthetic sequence (A2 KRAS TCR15 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAEMMDTDKLIFGTGTRLQVFPN

SEQ ID NO: 456 - DNA, 936 bp, Artificial Sequence
  Synthetic sequence (A2 KRAS TCR15 - TCRbeta)
atgggcaccaggctcctctgctgggcggccctctgtctcctgggagcagaactcacagaagctggagttgcccagtctcccagatataagattatagagaaaaggcagagtgtggctttttggtgcaatcctatatctggccatgctaccctttactggtaccagcagatcctgggacagggcccaaagcttctgattcagtttcagaataacggtgtagtggatgattcacagttgcctaaggatcgattttctgcagagaggctcaaaggagtagactccactctcaagatccaacctgcaaagcttgaggactcggccgtgtatctctgtgccagcagcttgcctagcgggaatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 457 - protein, 311 aa, Artificial Sequence
  Synthetic sequence (A2 KRAS TCR15 - TCRbeta)
MGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLPSGNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 458 - protein, 113 aa, Artificial Sequence
  Synthetic sequence (A2 KRAS TCR15 - TCR Vbeta)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLPSGNEQFFGPGTRLTVL

SEQ ID NO: 459 - DNA, 1490 bp, Artificial Sequence
  Synthetic sequence (A2 KRAS TCR15 - TCRbeta-P2A-TCRalpha fragment)
ctcaataaaagagcccacaacccctcactcggcgcgccaccatgggcacaagacttctctgttgggctgctctttgtctgcttggagctgaactgacagaagctggagttgcccagtctcctaggtacaagatcatcgagaagaggcagtctgtggccttttggtgcaatcccattagcggacacgccaccctgtactggtatcagcaaattctgggacaaggccctaaactgctgatccagttccagaacaacggcgtggtggacgattctcaactgcctaaggacaggttttctgccgagagactgaaaggcgtggatagcaccctgaagatccaaccagccaaactggaggattctgctgtgtacctgtgtgcttctagcctgccaagcggcaatgagcagttttttggacctggcacaagactgacagtgctggaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagatgatggacaccgacaagctgatctttggaacaggcaccagactgcaggtgttccccaatatccagaatcctgatcctgccgtgtaccagctgcgggacagcaagagcagcgac

SEQ ID NO: 460 - protein, 495 aa, Artificial Sequence
  Synthetic sequence (A2 KRAS TCR15 - TCRbeta-P2A-TCRalpha fragment)
QKSPQPLTRRATMGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSLPSGNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEMMDTDKLIFGTGTRLQVFPNIQNPDPAVYQLRDSKSSD

SEQ ID NO: 461 - DNA, 825 bp, Artificial Sequence
  Synthetic sequence (A2 KRAS TCR16 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagatcgtagataaccagggaggaaagcttatcttcggacagggaacggagttatctgtgaaacccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 462 - protein, 274 aa, Artificial Sequence
  Synthetic sequence (A2 KRAS TCR16 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIVDNQGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 463 - protein, 113 aa, Artificial Sequence
  Synthetic sequence (A2 KRAS TCR16 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAEIVDNQGGKLIFGQGTELSVKPN

SEQ ID NO: 464 - DNA, 933 bp, Artificial Sequence
  Synthetic sequence (A2 KRAS TCR16 - TCRbeta)
atggcctccctgctcttcttctgtggggccttttatctcctgggaacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtggacaggggggcgatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 465 - protein, 310 aa, Artificial Sequence
  Synthetic sequence (A2 KRAS TCR16 - TCRbeta)
MASLLFFCGAFYLLGTGSMDADVTQTPRNRITKTGKRIMLECSQTKGHDRMYWYRQDPGLGLRLIYYSFDVKDINKGEISDGYSVSRQAQAKFSLSLESAIPNQTALYFCATSGQGGDEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 466 - protein, 112 aa, Artificial Sequence
  Synthetic sequence (A2 KRAS TCR16 - TCR Vbeta)
DADVTQTPRNRITKTGKRIMLECSQTKGHDRMYWYRQDPGLGLRLIYYSFDVKDINKGEISDGYSVSRQAQAKFSLSLESAIPNQTALYFCATSGQGGDEQFFGPGTRLTVL

SEQ ID NO: 467 - DNA, 1493 bp, Artificial Sequence
  Synthetic sequence (A2 KRAS TCR16 - TCRbeta-P2A-TCRalpha fragment)
ctcaataaaagagcccacaacccctcactcggcgcgccaccatggcttctctcctgttcttctgtggcgccttttacctgctgggaacaggctctatggatgctgatgtgacacagacccccagaaacagaatcaccaagacaggcaagcggatcatgctggagtgtagccagacaaaaggccacgaccggatgtactggtatagacaagatcctggactgggactgaggctgatctactacagcttcgacgtgaaggacatcaacaagggcgagatctctgatggctacagcgtgagcagacaggctcaggccaagttttctctgtctctggaatctgccatccctaatcagacagccctgtacttttgcgccacaagcggccaaggaggagatgagcagttttttggaccaggaacaagactgaccgtgttagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagatcgtggacaatcagggcggaaagctgatttttggacagggaacagagctgagcgtgaagcccaacatccagaatcctgatcctgccgtgtaccagctgcgggacagcaagagcagcgac

SEQ ID NO: 468 - protein, 496 aa, Artificial Sequence
  Synthetic sequence (A2 KRAS TCR16 - TCRbeta-P2A-TCRalpha fragment)
QKSPQPLTRRATMASLLFFCGAFYLLGTGSMDADVTQTPRNRITKTGKRIMLECSQTKGHDRMYWYRQDPGLGLRLIYYSFDVKDINKGEISDGYSVSRQAQAKFSLSLESAIPNQTALYFCATSGQGGDEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEIVDNQGGKLIFGQGTELSVKPNIQNPDPAVYQLRDSKSSD

SEQ ID NO: 469 - DNA, 807 bp, Artificial Sequence
  Synthetic sequence (A2 KRAS TCR17 - TCRalpha)
atggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcagggtctaacgactacaagctcagctttggagccggaaccacagtaactgtaagagcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 470 - protein, 268 aa, Artificial Sequence
  Synthetic sequence (A2 KRAS TCR17 - TCRalpha)
MVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGSNDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 471 - protein, 110 aa, Artificial Sequence
  Synthetic sequence (A2 KRAS TCR17 - TCR Valpha)
TQLLEQSPQFLSIQEGENLTVYCNSSSVFSSLQWYRQEPGEGPVLLVTVVTGGEVKKLKRLTFQFGDARKDSSLHITAAQPGDTGLYLCAGSNDYKLSFGAGTTVTVRAN

SEQ ID NO: 472 - DNA, 936 bp, Artificial Sequence
  Synthetic sequence (A2 KRAS TCR17 - TCRbeta)
atgctgctgcttctgctgcttctggggccagcaggctccgggcttggtgctgtcgtctctcaacatccgagcagggttatctgtaagagtggaacctctgtgaagatcgagtgccgttccctggactttcaggccacaactatgttttggtatcgtcagttcccgaaaaagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgccgatagactagcgggaggggaagagacccagtacttcgggccaggcacgcggctcctggtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 473 - protein, 311 aa, Artificial Sequence
  Synthetic sequence (A2 KRAS TCR17 - TCRbeta)
MLLLLLLLGPAGSGLGAVVSQHPSRVICKSGTSVKIECRSLDFQATTMFWYRQFPKKSLMLMATSNEGSKATYEQGVEKDKFLINHASLTLSTLTVTSAHPEDSSFYICSADRLAGGEETQYFGPGTRLLVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 474 - protein, 117 aa, Artificial Sequence
  Synthetic sequence (A2 KRAS TCR17 - TCRbeta)
GAVVSQHPSRVICKSGTSVKIECRSLDFQATTMFWYRQFPKKSLMLMATSNEGSKATYEQGVEKDKFLINHASLTLSTLTVTSAHPEDSSFYICSADRLAGGEETQYFGPGTRLLVL

SEQ ID NO: 475 - DNA, 1478 bp, Artificial Sequence
  Synthetic sequence (A2 KRAS TCR17 - TCRbeta-P2A-TCRalpha fragment)
ctcaataaaagagcccacaacccctcactcggcgcgccaccatgctgcttcttctcctccttctcggacctgctggatctggattaggagctgttgtgtctcagcacccttctagagtgatctgcaaaagcggcaccagcgtgaagatcgagtgtagaagcctggactttcaggccacaaccatgttctggtataggcagttccccaagaagagcctgatgctgatggccacctctaatgagggcagcaaagccacatatgaacagggagtggagaaggacaagttcctgatcaaccacgcctctctgaccctgtctaccctgacagttacatctgcccaccctgaggatagcagcttttacatctgtagcgccgacagacttgctggaggagaggaaacacagtactttggccctggcaccagactgttagtgttagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggtgctgaagttctctgtctcgatcctgtggatccagcttgcttgggtgtctacacagctgctggaacagtctcctcagtttctgagcattcaggaaggcgagaatctgaccgtgtactgcaacagcagcagcgtgtttagcagcttacagtggtacagacaggagcctggagaaggaccagtgttactggtgacagtggtgacaggaggagaagtgaagaagctgaagagactgaccttccagttcggcgatgccagaaaggatagctctctgcacatcacagctgctcaacctggagatacaggcctgtatctgtgtgccggcagcaatgactataagctgagctttggagccggaacaaccgtgacagtgagagccaatatccagaaccccgatcctgctgtgtaccagctgcgggacagcaagagcagcgac

SEQ ID NO: 476 - protein, 491 aa, Artificial Sequence
  Synthetic sequence (A2 KRAS TCR17 - TCRbeta-P2A-TCRalpha fragment)
QKSPQPLTRRATMLLLLLLLGPAGSGLGAVVSQHPSRVICKSGTSVKIECRSLDFQATTMFWYRQFPKKSLMLMATSNEGSKATYEQGVEKDKFLINHASLTLSTLTVTSAHPEDSSFYICSADRLAGGEETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMVLKFSVSILWIQLAWVSTQLLEQSPQFLSIQEGENLTVYCNSSSVFSSLQWYRQEPGEGPVLLVTVVTGGEVKKLKRLTFQFGDARKDSSLHITAAQPGDTGLYLCAGSNDYKLSFGAGTTVTVRANIQNPDPAVYQLRDSKSSD

SEQ ID NO: 477 - DNA, 825 bp, Artificial Sequence
  Synthetic sequence (A2 KRAS TCR18 - TCRalpha)
atgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagtacttctggataaccagggaggaaagcttatcttcggacagggaacggagttatctgtgaaacccaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 478 - protein, 274 aa, Artificial Sequence
  Synthetic sequence (A2 KRAS TCR18 - TCRalpha)
MKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVLLDNQGGKLIFGQGTELSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 479 - protein, 113 aa, Artificial Sequence
  Synthetic sequence (A2 KRAS TCR18 - TCR Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAVLLDNQGGKLIFGQGTELSVKPN

SEQ ID NO: 480 - DNA, 933 bp, Artificial Sequence
  Synthetic sequence (A2 KRAS TCR18 - TCRbeta)
atgggaatcaggctcctgtgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcaggggtctgtccacagatacgcagtattttggcccaggcacccggctgacagtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 481 - protein, 310 aa, Artificial Sequence
  Synthetic sequence (A2 KRAS TCR18 - TCRbeta)
MGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASRGLSTDTQYFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 482 - protein, 112 aa, Artificial Sequence
  Synthetic sequence (A2 KRAS TCR18 - TCR Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCASRGLSTDTQYFGPGTRLTVL

SEQ ID NO: 483 - DNA, 1493 bp, Artificial Sequence
  Synthetic sequence (A2 KRAS TCR18 - TCRbeta-P2A-TCRalpha fragment)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctctagaggactgtctaccgatacccagtatttcggacctggaacaagactgacagtgctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgctgtgctgctggacaatcagggcggaaagctgatctttggacagggaacagagctgtctgtgaagcctaacatccagaaccctgatcctgccgtgtaccagctgcgggacagcaagagcagcgac

SEQ ID NO: 484 - protein, 496 aa, Artificial Sequence
  Synthetic sequence (A2 KRAS TCR18 - TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASRGLSTDTQYFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAVLLDNQGGKLIFGQGTELSVKPNIQNPDPAVYQLRDSKSSD

SEQ ID NO: 485 - DNA, 822 bp, Artificial Sequence
  Synthetic sequence (A2 KRAS TCR19 - TCRalpha)
atgctcctgttgctcataccagtgctggggatgatttttgccctgagagatgccagagcccagtctgtgagccagcataaccaccacgtaattctctctgaagcagcctcactggagttgggatgcaactattcctatggtggaactgttaatctcttctggtatgtccagtaccctggtcaacaccttcagcttctcctcaagtacttttcaggggatccactggttaaaggcatcaagggctttgaggctgaatttataaagagtaaattctcctttaatctgaggaaaccctctgtgcagtggagtgacacagctgagtacttctgtgccgtgaatgatccaagcgactacaagctcagctttggagccggaaccacagtaactgtaagagcaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 486 - protein, 273 aa, Artificial Sequence
  Synthetic sequence (A2 KRAS TCR19 - TCRalpha)
MLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVNDPSDYKLSFGAGTTVTVRANIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 487 - protein, 114 aa, Artificial Sequence
  Synthetic sequence (A2 KRAS TCR19 - TCR Valpha)
AQSVSQHNHHVILSEAASLELGCNYSYGGTVNLFWYVQYPGQHLQLLLKYFSGDPLVKGIKGFEAEFIKSKFSFNLRKPSVQWSDTAEYFCAVNDPSDYKLSFGAGTTVTVRAN

SEQ ID NO: 488 - DNA, 930 bp, Artificial Sequence
  Synthetic sequence (A2 KRAS TCR19 - TCRbeta)
atgagcaaccaggtgctctgctgtgtggtcctttgtttcctgggagcaaacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtaggagcgaccgcaatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 489 - protein, 309 aa, Artificial Sequence
  Synthetic sequence (A2 KRAS TCR19 - TCRbeta)
MSNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASRSDRNEQFFGPGTRLTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 490 - protein, 111 aa, Artificial Sequence
  Synthetic sequence (A2 KRAS TCR19 - TCR Vbeta)
DGGITQSPKYLFRKEGQNVTLSCEQNLNHDAMYWYRQDPGQGLRLIYYSQIVNDFQKGDIAEGYSVSREKKESFPLTVTSAQKNPTAFYLCASRSDRNEQFFGPGTRLTVL

SEQ ID NO: 491 - DNA, 1487 bp, Artificial Sequence
  Synthetic sequence (A2 KRAS TCR19 - TCRbeta-P2A-TCRalpha fragment)
ctcaataaaagagcccacaacccctcactcggcgcgccaccatgagcaaccaggtcttgtgctgtgtggtgctgtgctttcttggcgccaatacagtggatggcggcattacacaaagccccaagtacctgttcaggaaagagggccagaatgtgacactgagctgtgagcagaacctgaatcacgacgccatgtactggtacagacaggatccaggacaaggactgaggctgatctactactcccagatcgtgaacgacttccagaagggcgatattgccgagggctatagcgtgagcagagagaagaaagagagcttcccactgacagtgacatctgcccagaagaaccctaccgccttctacctgtgtgcctctagaagcgacagaaatgagcagttttttggccctggcacaagactgaccgtgctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgctgcttctcctgatccctgttctgggcatgatctttgccctgagagatgctagagcccagtctgtttctcagcacaaccatcacgtgatcctgtctgaagctgcctctctggaactgggctgcaactactcttatggcggaaccgttaacctgttctggtatgtgcagtaccctggacagcatctgcagctgctgctgaagtacttctctggcgatcctctggtgaaaggcattaagggctttgaggccgagttcatcaagtccaagttcagcttcaacctgcggaagccctctgtgcaatggagcgatacagccgagtacttttgtgccgtgaatgatcctagcgactacaagctgagctttggagccggcacaacagtgaccgtgagagccaatatccagaatcctgatcctgctgtgtaccagctgcgggacagcaagagcagcgac

SEQ ID NO: 492 - protein, 494 aa, Artificial Sequence
  Synthetic sequence (A2 KRAS TCR19 - TCRbeta-P2A-TCRalpha fragment)
QKSPQPLTRRATMSNQVLCCVVLCFLGANTVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASRSDRNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLIPVLGMIFALRDARAQSVSQHNHHVILSEAASLELGCNYSYGGTVNLFWYVQYPGQHLQLLLKYFSGDPLVKGIKGFEAEFIKSKFSFNLRKPSVQWSDTAEYFCAVNDPSDYKLSFGAGTTVTVRANIQNPDPAVYQLRDSKSSD

SEQ ID NO: 493 - protein, 6 aa, Artificial Sequence
  Synthetic sequence (A11 KRAS TCR_220_12 CDR1alpha)
SSYSPS

SEQ ID NO: 494 - protein, 8 aa, Artificial Sequence
  Synthetic sequence (A11 KRAS TCR_220_12 CDR2alpha)
YTSAATLV

SEQ ID NO: 495 - protein, 14 aa, Artificial Sequence
  Synthetic sequence (A11 KRAS TCR_220_12 CDR3alpha)
CVVSDMVSGYALNF

SEQ ID NO: 496 - protein, 5 aa, Artificial Sequence
  Synthetic sequence (A11 KRAS TCR_220_12 CDR1beta)
MGHDK

SEQ ID NO: 497 - protein, 6 aa, Artificial Sequence
  Synthetic sequence (A11 KRAS TCR_220_12 CDR2beta)
SYGVNS

SEQ ID NO: 498 - protein, 13 aa, Artificial Sequence
  Synthetic sequence (A11 KRAS TCR_220_12 CDR3beta)
CASSESLYNEQFF

SEQ ID NO: 499 - DNA, 1493 bp, Artificial Sequence
  Synthetic sequence (A11 KRAS TCR_220_12 TCRbeta-P2A-TCRalpha fragment)
ctcaataaaagagcccacaacccctcactcggcgcgccaccatgaccattcgactgctgtgctacatgggcttctacttcctgggagctggactgatggaagccgacatttaccaaacccccagatacctggtgatcggaacaggcaagaagatcaccctggagtgtagccagacaatgggacacgacaagatgtactggtaccagcaggatcctggaatggaactgcacctgatccactacagctatggcgtgaacagcacagagaaaggcgatctgagctctgagtctacagtgagcagaatcaggaccgagcacttcccactgacactggaatctgctagacctagccacacaagccagtacctttgtgcctctagcgagtctctgtacaacgagcagttctttggacctggcaccagactgacagtgcttgaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgctgcttcttctcgtccctgtcctggaggtgatctttacactgggaggcacaagagctcagtctgttacacagctggattctcacgtgagcgtgtctgagggaacacctgtgctgctgagatgcaactactcttctagctactctcctagcctgttctggtacgtgcagcaccccaataagggcctgcaacttctgctgaaatacacatctgccgctacactggtgaagggcatcaacggctttgaagccgagttcaagaagagcgagacctcttttcacctgaccaagccttctgcccacatgagcgatgctgccgagtacttttgtgtggtgagcgatatggttagcggatatgccctgaacttcggcaagggaacaagcctgctggttacaccacacatccagaatcctgatcctgctgtgtaccagctgcgggacagcaagagcagcgac

SEQ ID NO: 500 - protein, 496 aa, Artificial Sequence
  Synthetic sequence (A11 KRAS TCR_220_12 TCRbeta-P2A-TCRalpha fragment)
QKSPQPLTRRATMTIRLLCYMGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSESLYNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLLLVPVLEVIFTLGGTRAQSVTQLDSHVSVSEGTPVLLRCNYSSSYSPSLFWYVQHPNKGLQLLLKYTSAATLVKGINGFEAEFKKSETSFHLTKPSAHMSDAAEYFCVVSDMVSGYALNFGKGTSLLVTPHIQNPDPAVYQLRDSKSSD

SEQ ID NO: 501 - protein, 110 aa, Artificial Sequence
  Synthetic sequence (A11 KRAS TCR_220_12 Vbeta)
DIYQTPRYLVIGTGKKITLECSQTMGHDKMYWYQQDPGMELHLIHYSYGVNSTEKGDLSSESTVSRIRTEHFPLTLESARPSHTSQYLCASSESLYNEQFFGPGTRLTVL

SEQ ID NO: 502 - protein, 115 aa, Artificial Sequence
  Synthetic sequence (A11 KRAS TCR_220_12 Valpha)
AQSVTQLDSHVSVSEGTPVLLRCNYSSSYSPSLFWYVQHPNKGLQLLLKYTSAATLVKGINGFEAEFKKSETSFHLTKPSAHMSDAAEYFCVVSDMVSGYALNFGKGTSLLVTPH

SEQ ID NO: 503 - protein, 6 aa, Artificial Sequence
  Synthetic sequence (A11 KRAS TCR_220_21 CDR1alpha)
DSSSTY

SEQ ID NO: 504 - protein, 7 aa, Artificial Sequence
  Synthetic sequence (A11 KRAS TCR_220_21 CDR2alpha)
IFSNMDM

SEQ ID NO: 505 - protein, 14 aa, Artificial Sequence
  Synthetic sequence (A11 KRAS TCR_220_21 CDR3alpha)
CAEPIIGGNTPLVF

SEQ ID NO: 506 - protein, 5 aa, Artificial Sequence
  Synthetic sequence (A11 KRAS TCR_220_21 CDR1beta)
SGHVS

SEQ ID NO: 507 - protein, 6 aa, Artificial Sequence
  Synthetic sequence (A11 KRAS TCR_220_21 CDR2beta)
FQNEAQ

SEQ ID NO: 508 - protein, 19 aa, Artificial Sequence
  Synthetic sequence (A11 KRAS TCR_220_21 CDR3beta)
CASSSEGLAGGPTAGELFF

SEQ ID NO: 509 - DNA, 1514 bp, Artificial Sequence
  Synthetic sequence (A11 KRAS TCR_220_21 TCRbeta-P2A-TCRalpha fragment)
ctcaataaaagagcccacaacccctcactcggcgcgccaccatgggcacaagacttctctgctgggtggtgcttggatttctgggcacagatcatacaggagctggagttagccagtctcctaggtacaaagtggccaagagaggacaggatgtggctctgagatgtgaccctattagcggacatgtgagcctgttttggtaccagcaagctctgggacaaggacccgagtttctgacctacttccagaatgaagcccagctggataaatctggactgcctagcgaccggttcttcgccgaaagacctgaaggatctgttagcaccctgaagattcagagaacacagcaggaggactctgccgtgtacctgtgtgcctcttcttctgaaggactggctggaggacctacagctggagaactgttttttggagagggctctaggctgacagttttggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgaagacctttgccggattctccttcctgttcctgtggctgcagctggattgtatgagcagaggcgaagatgtggaacagagcctgtttctgagcgtgagagagggagatagcagcgtgatcaattgcacctacaccgattctagcagcacctacctgtactggtacaagcaggaacctggagccggattacaactgctgacctacatcttcagcaacatggacatgaagcaggaccagagactgaccgtgctgctgaacaagaaggacaagcacctgagcctgagaattgccgatacacagacaggagatagcgccatctacttctgtgccgagcctatcattggcggcaatacacctctggtgtttggaaagggcacaaggctgtctgtgattgccaacatccagaatcccgaccctgctgtgtaccagctgcgggacagcaagagcagcgac

SEQ ID NO: 510 - protein, 503 aa, Artificial Sequence
  Synthetic sequence (A11 KRAS TCR_220_21 TCRbeta-P2A-TCRalpha fragment)
QKSPQPLTRRATMGTRLLCWVVLGFLGTDHTGAGVSQSPRYKVAKRGQDVALRCDPISGHVSLFWYQQALGQGPEFLTYFQNEAQLDKSGLPSDRFFAERPEGSVSTLKIQRTQQEDSAVYLCASSSEGLAGGPTAGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMKTFAGFSFLFLWLQLDCMSRGEDVEQSLFLSVREGDSSVINCTYTDSSSTYLYWYKQEPGAGLQLLTYIFSNMDMKQDQRLTVLLNKKDKHLSLRIADTQTGDSAIYFCAEPIIGGNTPLVFGKGTRLSVIANIQNPDPAVYQLRDSKSSD

SEQ ID NO: 511 - protein, 119 aa, Artificial Sequence
  Synthetic sequence (A11 KRAS TCR_220_21 Vbeta)
GAGVSQSPRYKVAKRGQDVALRCDPISGHVSLFWYQQALGQGPEFLTYFQNEAQLDKSGLPSDRFFAERPEGSVSTLKIQRTQQEDSAVYLCASSSEGLAGGPTAGELFFGEGSRLTVL

SEQ ID NO: 512 - protein, 113 aa, Artificial Sequence
  Synthetic sequence (A11 KRAS TCR_220_21 Valpha)
GEDVEQSLFLSVREGDSSVINCTYTDSSSTYLYWYKQEPGAGLQLLTYIFSNMDMKQDQRLTVLLNKKDKHLSLRIADTQTGDSAIYFCAEPIIGGNTPLVFGKGTRLSVIAN

SEQ ID NO: 513 - protein, 5 aa, Artificial Sequence
  Synthetic sequence (A11 KRAS TCR_129_2 CDR1alpha)
TSINN

SEQ ID NO: 514 - protein, 7 aa, Artificial Sequence
  Synthetic sequence (A11 KRAS TCR_129_2 CDR2alpha)
IRSNERE

SEQ ID NO: 515 - protein, 13 aa, Artificial Sequence
  Synthetic sequence (A11 KRAS TCR_129_2 CDR3alpha)
CASSGGGADGLTF

SEQ ID NO: 516 - protein, 5 aa, Artificial Sequence
  Synthetic sequence (A11 KRAS TCR_129_2 CDR1beta)
SGHRS

SEQ ID NO: 517 - protein, 6 aa, Artificial Sequence
  Synthetic sequence (A11 KRAS TCR_129_2 CDR2beta)
YFSETQ

SEQ ID NO: 518 - protein, 14 aa, Artificial Sequence
  Synthetic sequence (A11 KRAS TCR_129_2 CDR3beta)
CASSLGGAGETQYF

SEQ ID NO: 519 - DNA, 1490 bp, Artificial Sequence
  Synthetic sequence (A11 KRAS TCR_129_2 TCRbeta-P2A-TCRalpha fragment)
ctcaataaaagagcccacaacccctcactcggcgcgccaccatgggctctagactgttgtgttgggttctgctgtgtctgcttggagctggacctgtgaaagctggagttacccagacacccagatatctgatcaagaccagaggacagcaggtgacactgagctgtagccctattagcggccacagatctgttagctggtatcagcaaacaccaggacagggactgcagttcctgttcgagtacttcagcgagacccagaggaataagggcaattttccaggcaggtttagcggcaggcagttcagcaactctagaagcgagatgaacgtgagcacccttgaattgggcgattctgccctgtacctgtgtgcctcttctttaggaggagctggagaaacccagtactttggacctggcacaagactgctggtgcttgaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgcctcttctggaggaggagctgatggacttacatttggaaagggcacccacctgatcatccagccttacatccagaaccctgatcctgccgtgtaccagctgcgggacagcaagagcagcgac

SEQ ID NO: 520 - protein, 495 aa, Artificial Sequence
  Synthetic sequence (A11 KRAS TCR_129_2 TCRbeta-P2A-TCRalpha fragment)
QKSPQPLTRRATMGSRLLCWVLLCLLGAGPVKAGVTQTPRYLIKTRGQQVTLSCSPISGHRSVSWYQQTPGQGLQFLFEYFSETQRNKGNFPGRFSGRQFSNSRSEMNVSTLELGDSALYLCASSLGGAGETQYFGPGTRLLVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCASSGGGADGLTFGKGTHLIIQPYIQNPDPAVYQLRDSKSSD

SEQ ID NO: 521 - protein, 113 aa, Artificial Sequence
  Synthetic sequence (A11 KRAS TCR_129_2 Vbeta)
KAGVTQTPRYLIKTRGQQVTLSCSPISGHRSVSWYQQTPGQGLQFLFEYFSETQRNKGNFPGRFSGRQFSNSRSEMNVSTLELGDSALYLCASSLGGAGETQYFGPGTRLLVL

SEQ ID NO: 522 - protein, 112 aa, Artificial Sequence
  Synthetic sequence (A11 KRAS TCR_129_2 Valpha)
SQQGEEDPQALSIQEGENATMNCSYKTSINNLQWYRQNSGRGLVHLILIRSNEREKHSGRLRVTLDTSKKSSSLLITASRAADTASYFCASSGGGADGLTFGKGTHLIIQPY

SEQ ID NO: 523 - protein, 6 aa, Artificial Sequence
  Synthetic sequence (A11 KRAS TCR_129_3 CDR1alpha)
NSASDY

SEQ ID NO: 524 - protein, 7 aa, Artificial Sequence
  Synthetic sequence (A11 KRAS TCR_129_3 CDR2alpha)
IRSNMDK

SEQ ID NO: 525 - protein, 15 aa, Artificial Sequence
  Synthetic sequence (A11 KRAS TCR_129_3 CDR3alpha)
CAENITPPEGFKTIF

SEQ ID NO: 526 - protein, 5 aa, Artificial Sequence
  Synthetic sequence (A11 KRAS TCR_129_3 CDR1beta)
WNHNN

SEQ ID NO: 527 - protein, 6 aa, Artificial Sequence
  Synthetic sequence (A11 KRAS TCR_129_3 CDR2beta)
SYGVQD

SEQ ID NO: 528 - protein, 14 aa, Artificial Sequence
  Synthetic sequence (A11 KRAS TCR_129_3 CDR3beta)
CASSGRGETGELFF

SEQ ID NO: 529 - DNA, 1499 bp, Artificial Sequence
  Synthetic sequence (A11 KRAS TCR_129_3 TCRbeta-P2A-TCRalpha fragment)
ctcaataaaagagcccacaacccctcactcggcgcgccaccatgggcacacggctgtttttctacgttgccctttgtctgctttgggctggccatagagatgccgagattacccagagccccagacacaaaattaccgagacaggaagacaggtgacactggcctgtcaccagacatggaaccacaacaacatgttctggtacaggcaggatctgggacatggactgcggctgatccactactcttatggcgtgcaggataccaataaaggcgaagtgtctgacggctacagcgtgagcaggagcaataccgaagatctgcctctgacactggaatctgctgcttcttctcagacaagcgtgtacttctgcgcctcttctggaagaggcgaaacaggagagctgttctttggcgaaggctctagactgacagttctggaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggccggcattagagcactcttcatgtacctgtggctgcaactggattgggtgtctagaggagagtctgtgggcctgcatcttcctacactgtctgttcaggaaggcgacaatagcatcatcaattgcgcctacagcaacagcgccagcgactacttcatctggtacaagcaggagagcggaaaaggacctcagttcatcatcgacatccggagcaacatggacaagagacagggacagagagtgaccgtgctgctgaacaagacagtgaaacatctgagcctgcagattgccgctacacaacctggcgattctgccgtgtacttttgtgccgagaatatcacacctcctgagggcttcaagaccatctttggcgccggaaccaggctgtttgttaaggccaatatccagaatcctgatcccgccgtgtaccagctgcgggacagcaagagcagcgac

SEQ ID NO: 530 - protein, 498 aa, Artificial Sequence
  Synthetic sequence (A11 KRAS TCR_129_3 TCRbeta-P2A-TCRalpha fragment)
QKSPQPLTRRATMGTRLFFYVALCLLWAGHRDAEITQSPRHKITETGRQVTLACHQTWNHNNMFWYRQDLGHGLRLIHYSYGVQDTNKGEVSDGYSVSRSNTEDLPLTLESAASSQTSVYFCASSGRGETGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAGIRALFMYLWLQLDWVSRGESVGLHLPTLSVQEGDNSIINCAYSNSASDYFIWYKQESGKGPQFIIDIRSNMDKRQGQRVTVLLNKTVKHLSLQIAATQPGDSAVYFCAENITPPEGFKTIFGAGTRLFVKANIQNPDPAVYQLRDSKSSD

SEQ ID NO: 531 - protein, 113 aa, Artificial Sequence
  Synthetic sequence (A11 KRAS TCR_129_3 Vbeta)
DAEITQSPRHKITETGRQVTLACHQTWNHNNMFWYRQDLGHGLRLIHYSYGVQDTNKGEVSDGYSVSRSNTEDLPLTLESAASSQTSVYFCASSGRGETGELFFGEGSRLTVL

SEQ ID NO: 532 - protein, 115 aa, Artificial Sequence
  Synthetic sequence (A11 KRAS TCR_129_3 Valpha)
GESVGLHLPTLSVQEGDNSIINCAYSNSASDYFIWYKQESGKGPQFIIDIRSNMDKRQGQRVTVLLNKTVKHLSLQIAATQPGDSAVYFCAENITPPEGFKTIFGAGTRLFVKAN

SEQ ID NO: 533 - protein, 5 aa, Artificial Sequence
  Synthetic sequence (A11 KRAS TCR_129_4 CDR1alpha)
TSINN

SEQ ID NO: 534 - protein, 7 aa, Artificial Sequence
  Synthetic sequence (A11 KRAS TCR_129_4 CDR2alpha)
IRSNERE

SEQ ID NO: 535 - protein, 11 aa, Artificial Sequence
  Synthetic sequence (A11 KRAS TCR_129_4 CDR3alpha)
CSGGSNYKLTF

SEQ ID NO: 536 - protein, 5 aa, Artificial Sequence
  Synthetic sequence (A11 KRAS TCR_129_4 CDR1beta)
MDHEN

SEQ ID NO: 537 - protein, 6 aa, Artificial Sequence
  Synthetic sequence (A11 KRAS TCR_129_4 CDR2beta)
SYDVKM

SEQ ID NO: 538 - protein, 14 aa, Artificial Sequence
  Synthetic sequence (A11 KRAS TCR_129_4 CDR3beta)
CASSLGRGGNTIYF

SEQ ID NO: 539 - DNA, 1478 bp, Artificial Sequence
  Synthetic sequence (A11 KRAS TCR_129_4 TCRbeta-P2A-TCRalpha fragment)
ctcaataaaagagcccacaacccctcactcggcgcgccaccatgggcatcagactcctttgcagggtggccttttgctttctggctgtgggattagtggacgtgaaggttacccagagcagcagatatctggtgaagagaaccggcgagaaggtgttcctggaatgtgtgcaggatatggaccacgagaacatgttctggtacagacaggaccctggactgggactgagactgatctacttcagctacgacgtgaagatgaaggagaagggcgatatccctgagggctacagcgtgagcagagagaaaaaggagaggttcagcctgattctggaaagcgccagcacaaatcagaccagcatgtacctgtgcgcctcttctctgggaagaggaggaaataccatctacttcggcgaaggatcttggctgacagtggtggaggatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgttctggcggaagcaactacaagctgacatttggcaagggaaccctgctgaccgtgaaccccaatatccagaatcccgatcctgctgtgtaccagctgcgggacagcaagagcagcgac

SEQ ID NO: 540 - protein, 491 aa, Artificial Sequence
  Synthetic sequence (A11 KRAS TCR_129_4 TCRbeta-P2A-TCRalpha fragment)
QKSPQPLTRRATMGIRLLCRVAFCFLAVGLVDVKVTQSSRYLVKRTGEKVFLECVQDMDHENMFWYRQDPGLGLRLIYFSYDVKMKEKGDIPEGYSVSREKKERFSLILESASTNQTSMYLCASSLGRGGNTIYFGEGSWLTVVEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMETLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCSGGSNYKLTFGKGTLLTVNPNIQNPDPAVYQLRDSKSSD

SEQ ID NO: 541 - protein, 113 aa, Artificial Sequence
  Synthetic sequence (A11 KRAS TCR_129_4 Vbeta)
DVKVTQSSRYLVKRTGEKVFLECVQDMDHENMFWYRQDPGLGLRLIYFSYDVKMKEKGDIPEGYSVSREKKERFSLILESASTNQTSMYLCASSLGRGGNTIYFGEGSWLTVV

SEQ ID NO: 542 - protein, 110 aa, Artificial Sequence
  Synthetic sequence (A11 KRAS TCR_129_4 Valpha)
SQQGEEDPQALSIQEGENATMNCSYKTSINNLQWYRQNSGRGLVHLILIRSNEREKHSGRLRVTLDTSKKSSSLLITASRAADTASYFCSGGSNYKLTFGKGTLLTVNPN

SEQ ID NO: 543 - protein, 6 aa, Artificial Sequence
  Synthetic sequence (A11 KRAS TCR_129_5 CDR1alpha)
YGATPY

SEQ ID NO: 544 - protein, 8 aa, Artificial Sequence
  Synthetic sequence (A11 KRAS TCR_129_5 CDR2alpha)
YFSGDTLV

SEQ ID NO: 545 - protein, 13 aa, Artificial Sequence
  Synthetic sequence (A11 KRAS TCR_129_5 CDR3alpha)
CAVGASGTYKYIF

SEQ ID NO: 546 - protein, 5 aa, Artificial Sequence
  Synthetic sequence (A11 KRAS TCR_129_5 CDR1beta)
SGHNS

SEQ ID NO: 547 - protein, 6 aa, Artificial Sequence
  Synthetic sequence (A11 KRAS TCR_129_5 CDR2beta)
FNNNVP

SEQ ID NO: 548 - protein, 13 aa, Artificial Sequence
  Synthetic sequence (A11 KRAS TCR_129_5 CDR3beta)
CASSLALSYEQYF

SEQ ID NO: 549 - DNA, 1493 bp, Artificial Sequence
  Synthetic sequence (A11 KRAS TCR_129_5 TCRbeta-P2A-TCRalpha fragment)
ctcaataaaagagcccacaacccctcactcggcgcgccaccatggatagctggaccttctgttgcgtgagcctgtgtatcctggtggccaaacacacagatgctggagtgattcagagccctagacatgaggtgaccgaaatgggacaggaggtgacactgagatgtaagcccatttctggccacaacagcctgttctggtacagacagaccatgatgaggggactggaactgctgatctacttcaacaacaacgtgcccatcgacgatagcggcatgcctgaggacagatttagcgccaagatgcctaatgccagcttttctaccctgaagatccagccctctgagcccagagattctgccgtgtacttttgtgcctcttctcttgctctgagctatgagcagtacttcggacccggcacaagactgaccgtgacagaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgctgctggaactgatacccctactgggcatccactttgtgctgagaacagctagagcccaatctgtgacacagcccgatatccacattaccgtgagcgaaggagcttctctggaactgagatgcaactacagctatggcgccaccccttaccttttctggtacgtgcagtctcctggacagggattacaactgctgctgaagtacttctccggcgatacactggttcagggcattaagggctttgaggccgagttcaagagaagccagagcagctttaacctgagaaagcctagcgtgcactggtctgatgctgccgagtacttttgtgctgtgggagcctctggaacatacaagtacatcttcggaaccggcacaaggctgaaggtgctggccaatatccagaaccctgatcctgctgtgtaccagctgcgggacagcaagagcagcgac

SEQ ID NO: 550 - protein, 496 aa, Artificial Sequence
  Synthetic sequence (A11 KRAS TCR_129_5 TCRbeta-P2A-TCRalpha fragment)
QKSPQPLTRRATMDSWTFCCVSLCILVAKHTDAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLALSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVGASGTYKYIFGTGTRLKVLANIQNPDPAVYQLRDSKSSD

SEQ ID NO: 551 - protein, 113 aa, Artificial Sequence
  Synthetic sequence (A11 KRAS TCR_129_5 Vbeta)
DAGVIQSPRHEVTEMGQEVTLRCKPISGHNSLFWYRQTMMRGLELLIYFNNNVPIDDSGMPEDRFSAKMPNASFSTLKIQPSEPRDSAVYFCASSLALSYEQYFGPGTRLTVT

SEQ ID NO: 552 - protein, 114 aa, Artificial Sequence
  Synthetic sequence (A11 KRAS TCR_129_5 Valpha)
AQSVTQPDIHITVSEGASLELRCNYSYGATPYLFWYVQSPGQGLQLLLKYFSGDTLVQGIKGFEAEFKRSQSSFNLRKPSVHWSDAAEYFCAVGASGTYKYIFGTGTRLKVLAN

SEQ ID NO: 553 - protein, 5 aa, Artificial Sequence
  Synthetic sequence (A11 KRAS TCR_129_7 CDR1alpha)
TSINN

SEQ ID NO: 554 - protein, 7 aa, Artificial Sequence
  Synthetic sequence (A11 KRAS TCR_129_7 CDR2alpha)
IRSNERE

SEQ ID NO: 555 - protein, 15 aa, Artificial Sequence
  Synthetic sequence (A11 KRAS TCR_129_7 CDR3alpha)
CATDALSWGAQKLVF

SEQ ID NO: 556 - protein, 5 aa, Artificial Sequence
  Synthetic sequence (A11 KRAS TCR_129_7 CDR1beta)
SGHAT

SEQ ID NO: 557 - protein, 6 aa, Artificial Sequence
  Synthetic sequence (A11 KRAS TCR_129_7 CDR2beta)
FQNNGV

SEQ ID NO: 558 - protein, 13 aa, Artificial Sequence
  Synthetic sequence (A11 KRAS TCR_129_7 CDR3beta)
CASSRGADYEQYF

SEQ ID NO: 559 - DNA, 1496 bp, Artificial Sequence
  Synthetic sequence (A11 KRAS TCR_129_7 TCRbeta-P2A-TCRalpha fragment)
ctcaataaaagagcccacaacccctcactcggcgcgccaccatgggcacaagacttctctgttgggctgctctttgtctgcttggagctgaactgacagaagctggagttgcccagtctcctaggtacaagatcatcgagaagaggcagtctgtggccttttggtgcaatcccattagcggacacgccaccctgtactggtatcagcaaattctgggacaaggccctaaactgctgatccagttccagaacaacggcgtggtggacgattctcaactgcctaaggacaggttttctgccgagagactgaaaggcgtggatagcaccctgaagatccaaccagccaaactggaggattctgctgtgtacctgtgtgctagctctagaggagccgactatgagcagtactttggacctggcacaagactgacagtgacagaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccacagatgctctttcttggggagctcaaaagctggtgtttggccagggaaccaggctgaccattaaccccaatatccagaatcctgatcctgccgtgtaccagctgcgggacagcaagagcagcgac

SEQ ID NO: 560 - protein, 497 aa, Artificial Sequence
  Synthetic sequence (A11 KRAS TCR_129_7 TCRbeta-P2A-TCRalpha fragment)
QKSPQPLTRRATMGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSRGADYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDALSWGAQKLVFGQGTRLTINPNIQNPDPAVYQLRDSKSSD

SEQ ID NO: 561 - protein, 113 aa, Artificial Sequence
  Synthetic sequence (A11 KRAS TCR_129_7 Vbeta)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSRGADYEQYFGPGTRLTVT

SEQ ID NO: 562 - protein, 114 aa, Artificial Sequence
  Synthetic sequence (A11 KRAS TCR_129_7 Valpha)
SQQGEEDPQALSIQEGENATMNCSYKTSINNLQWYRQNSGRGLVHLILIRSNEREKHSGRLRVTLDTSKKSSSLLITASRAADTASYFCATDALSWGAQKLVFGQGTRLTINPN

SEQ ID NO: 563 - protein, 6 aa, Artificial Sequence
  Synthetic sequence (A11 KRAS TCR_129_8 CDR1alpha)
NSMFDY

SEQ ID NO: 564 - protein, 7 aa, Artificial Sequence
  Synthetic sequence (A11 KRAS TCR_129_8 CDR2alpha)
ISSIKDK

SEQ ID NO: 565 - protein, 12 aa, Artificial Sequence
  Synthetic sequence (A11 KRAS TCR_129_8 CDR3alpha)
CAANTNAGKSTF

SEQ ID NO: 566 - protein, 5 aa, Artificial Sequence
  Synthetic sequence (A11 KRAS TCR_129_8 CDR1beta)
SEHNR

SEQ ID NO: 567 - protein, 6 aa, Artificial Sequence
  Synthetic sequence (A11 KRAS TCR_129_8 CDR2beta)
FQNEAQ

SEQ ID NO: 568 - protein, 12 aa, Artificial Sequence
  Synthetic sequence (A11 KRAS TCR_129_8 CDR3beta)
CASSTGTAEQYF

SEQ ID NO: 569 - DNA, 1505 bp, Artificial Sequence
  Synthetic sequence (A11 KRAS TCR_129_8 TCRbeta-P2A-TCRalpha fragment)
ctcaataaaagagcccacaacccctcactcggcgcgccaccatgggcacatctcttctctgctggatggctctttgtctgcttggagccgatcatgccgatacaggagttagccaggatcctagacacaagatcaccaagagaggccagaatgtgaccttccggtgcgatcctatctctgagcacaacaggctgtactggtacagacaaacactgggacaaggacctgagttcctgacctacttccagaacgaagcccagctggagaagtctagacttctgagcgacagatttagcgccgagagacctaaaggcagctttagcaccctggagatccagagaacagaacagggcgattctgccatgtacctgtgtgctagctctacaggaacagccgagcagtactttggacctggaaccagactgaccgtgacagaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggccatgttactaggagcgagcgtgctgattctgtggttacagcctgattgggtgaactctcagcagaagaacgatgatcagcaggtgaagcagaacagcccctctctgtctgtgcaggaaggcagaatcagcatcctgaattgcgattacaccaacagcatgttcgactacttcctgtggtacaagaagtaccccgccgagggccctacctttctgatcagcatctctagcatcaaggacaagaacgaagatggcagattcaccgtgttcctgaacaagagcgccaagcacctgagcctgcacattgtgccttctcaacctggagattctgccgtgtacttttgtgccgccaacacaaatgccggcaagagcacatttggcgatggcacaacactgaccgtgaagcctaatatccagaaccctgatccagccgtgtaccagctgcgggacagcaagagcagcgac

SEQ ID NO: 570 - protein, 500 aa, Artificial Sequence
  Synthetic sequence (A11 KRAS TCR_129_8 TCRbeta-P2A-TCRalpha fragment)
QKSPQPLTRRATMGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSTGTAEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMAMLLGASVLILWLQPDWVNSQQKNDDQQVKQNSPSLSVQEGRISILNCDYTNSMFDYFLWYKKYPAEGPTFLISISSIKDKNEDGRFTVFLNKSAKHLSLHIVPSQPGDSAVYFCAANTNAGKSTFGDGTTLTVKPNIQNPDPAVYQLRDSKSSD

SEQ ID NO: 571 - protein, 112 aa, Artificial Sequence
  Synthetic sequence (A11 KRAS TCR_129_8 Vbeta)
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSTGTAEQYFGPGTRLTVT

SEQ ID NO: 572 - protein, 112 aa, Artificial Sequence
  Synthetic sequence (A11 KRAS TCR_129_8 Valpha)
DQQVKQNSPSLSVQEGRISILNCDYTNSMFDYFLWYKKYPAEGPTFLISISSIKDKNEDGRFTVFLNKSAKHLSLHIVPSQPGDSAVYFCAANTNAGKSTFGDGTTLTVKPN

SEQ ID NO: 573 - protein, 7 aa, Artificial Sequence
  Synthetic sequence (A11 KRAS TCR_141_1 CDR1alpha)
TSESDYY

SEQ ID NO: 574 - protein, 8 aa, Artificial Sequence
  Synthetic sequence (A11 KRAS TCR_141_1 CDR2alpha)
QEAYKQQN

SEQ ID NO: 575 - protein, 12 aa, Artificial Sequence
  Synthetic sequence (A11 KRAS TCR_141_1 CDR3alpha)
CALKTSYDKVIF

SEQ ID NO: 576 - protein, 5 aa, Artificial Sequence
  Synthetic sequence (A11 KRAS TCR_141_1 CDR1beta)
MNHEY

SEQ ID NO: 577 - protein, 6 aa, Artificial Sequence
  Synthetic sequence (A11 KRAS TCR_141_1 CDR2beta)
SVGAGI

SEQ ID NO: 578 - protein, 16 aa, Artificial Sequence
  Synthetic sequence (A11 KRAS TCR_141_1 CDR3beta)
CASSLGAGEWKSPLHF

SEQ ID NO: 579 - DNA, 1496 bp, Artificial Sequence
  Synthetic sequence (A11 KRAS TCR_141_1 TCRbeta-P2A-TCRalpha fragment)
ctcaataaaagagcccacaacccctcactcggcgcgccaccatgtctatcggtctgctgtgctgtgctgctctttctctgctttgggctggacctgtgaatgctggagttacacaaacccccaagttccaagtgctgaagacaggacagagcatgaccctgcagtgtgctcaggacatgaatcacgagtacatgagctggtacagacaggatcctggaatgggcctgaggctgatccactactctgttggagccggaattacagatcagggagaagtgccaaatggctacaacgtgagcaggagcacaaccgaggacttccccttaagactgttgtctgctgctccatctcagacaagcgtgtacttttgcgcctcttctctgggagccggagaatggaaatctcctctgcactttggcaatggcaccagattaacagtgaccgaggatctgaacaaggtgttccccccagaggtggccgtgttcgagccttctgaggccgagatctcccacacccagaaagccaccctcgtgtgcctggccaccggctttttccccgaccacgtggaactgtcttggtgggtcaacggcaaagaggtgcactccggcgtgtgcaccgatccccagcctctgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacacagatcgtgtctgccgaagcctggggcagagccgattgcggctttacctccgtgtcctatcagcagggcgtgctgagcgccacaatcctgtacgagatcctgctgggcaaggccaccctgtacgccgtgctggtgtctgccctggtgctgatggccatggtcaagcggaaggacttcggttccggagccacgaacttctctctgttaaagcaagcaggagacgtggaagaaaaccccggtcccatggcttgtcctggattcttatgggctctggtgatcagcacctgtctggagttctctatggcccagacagtgacacagtctcagcctgaaatgtctgtgcaggaagccgaaaccgtgacactgtcttgcacctacgatacaagcgagagcgactactacctgttctggtacaagcagcctccctctaggcagatgatcctggtgattagacaggaggcctacaaacagcagaatgccaccgagaaccggtttagcgtgaacttccagaaagccgccaagagcttcagcctgaaaatctctgacagccagctgggagatgctgccatgtacttttgtgccctgaagaccagctacgacaaggtgatttttggacctggcacctctctgagcgtgatccccaatatccagaaccccgatcctgctgtgtaccagctgcgggacagcaagagcagcgac

SEQ ID NO: 580 - protein, 497 aa, Artificial Sequence
  Synthetic sequence (A11 KRAS TCR_141_1 TCRbeta-P2A-TCRalpha fragment)
QKSPQPLTRRATMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSLGAGEWKSPLHFGNGTRLTVTEDLNKVFPPEVAVFEPSEAEISHTQKATLVCLATGFFPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDFGSGATNFSLLKQAGDVEENPGPMACPGFLWALVISTCLEFSMAQTVTQSQPEMSVQEAETVTLSCTYDTSESDYYLFWYKQPPSRQMILVIRQEAYKQQNATENRFSVNFQKAAKSFSLKISDSQLGDAAMYFCALKTSYDKVIFGPGTSLSVIPNIQNPDPAVYQLRDSKSSD

SEQ ID NO: 581 - protein, 115 aa, Artificial Sequence
  Synthetic sequence (A11 KRAS TCR_141_1 Vbeta)
NAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSLGAGEWKSPLHFGNGTRLTVT

SEQ ID NO: 582 - protein, 114 aa, Artificial Sequence
  Synthetic sequence (A11 KRAS TCR_141_1 Valpha)
AQTVTQSQPEMSVQEAETVTLSCTYDTSESDYYLFWYKQPPSRQMILVIRQEAYKQQNATENRFSVNFQKAAKSFSLKISDSQLGDAAMYFCALKTSYDKVIFGPGTSLSVIPN

SEQ ID NO: 583 - protein, 6 aa, Artificial Sequence
  Synthetic sequence (A11 KRAS TCR_141_3 CDR1alpha)
VSGNPY

SEQ ID NO: 584 - protein, 8 aa, Artificial Sequence
  Synthetic sequence (A11 KRAS TCR_141_3 CDR2alpha)
YITGDNLV

SEQ ID NO: 585 - protein, 13 aa, Artificial Sequence
  Synthetic sequence (A11 KRAS TCR_141_3 CDR3alpha)
CAVISGGYNKLIF

SEQ ID NO: 586 - protein, 5 aa, Artificial Sequence
  Synthetic sequence (A11 KRAS TCR_141_3 CDR1beta)
LGHDT

SEQ ID NO: 587 - protein, 6 aa, Artificial Sequence
  Synthetic sequence (A11 KRAS TCR_141_3 CDR2beta)
YNNKEL

SEQ ID NO: 588 - protein, 16 aa, Artificial Sequence
  Synthetic sequence (A11 KRAS TCR_141_3 CDR3beta)
CASSSSGARGPYEQYF

SEQ ID NO: 589 - DNA, 1499 bp, Artificial Sequence
  Synthetic sequence (A11 KRAS TCR_141_3 TCRbeta-P2A-TCRalpha fragment)
ctcaataaaagagcccacaacccctcactcggcgcgccaccatgggctgtagactgttgtgttgcgtggtgttttgcctgctgcaagctggacctctggatacagctgttagccagacccctaagtatctggtgacccaaatgggcaacgataagagcatcaagtgcgagcagaatctgggccacgacaccatgtactggtacaagcaggacagcaagaagttcctgaagatcatgttcagctacaacaacaaggagctgatcatcaacgagaccgtgcccaaccggttcagccccaaaagccctgataaagctcacctgaatctgcacatcaattctctggaactgggcgactctgccgtgtacttctgcgcctctagctcttctggagctagaggaccttatgaacagtattttggccctggcaccagactgacagtgaccgaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggcttcagcacctatctccatgctggctatgctgttcacactgtctggccttagagcccagtctgttgctcaacctgaggatcaggtgaatgtggctgagggaaatccactgaccgtgaagtgcacctactctgtgtctggcaacccttacctgttttggtacgtgcagtaccccaatagaggcctgcagttcctgctgaagtacatcaccggcgacaatctggtgaaaggatcttacggctttgaagccgagttcaacaagagccagaccagcttccacctgaagaagccttctgctctggtgagcgattctgccctgtacttttgtgccgtgatttctggcggctacaacaagctgatctttggagccggcacaagactggccgttcatccttacatccagaatcctgaccctgctgtgtaccagctgcgggacagcaagagcagcgac

SEQ ID NO: 590 - protein, 498 aa, Artificial Sequence
  Synthetic sequence (A11 KRAS TCR_141_3 TCRbeta-P2A-TCRalpha fragment)
QKSPQPLTRRATMGCRLLCCVVFCLLQAGPLDTAVSQTPKYLVTQMGNDKSIKCEQNLGHDTMYWYKQDSKKFLKIMFSYNNKELIINETVPNRFSPKSPDKAHLNLHINSLELGDSAVYFCASSSSGARGPYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMASAPISMLAMLFTLSGLRAQSVAQPEDQVNVAEGNPLTVKCTYSVSGNPYLFWYVQYPNRGLQFLLKYITGDNLVKGSYGFEAEFNKSQTSFHLKKPSALVSDSALYFCAVISGGYNKLIFGAGTRLAVHPYIQNPDPAVYQLRDSKSSD

SEQ ID NO: 591 - protein, 115 aa, Artificial Sequence
  Synthetic sequence (A11 KRAS TCR_141_3 Vbeta)
DTAVSQTPKYLVTQMGNDKSIKCEQNLGHDTMYWYKQDSKKFLKIMFSYNNKELIINETVPNRFSPKSPDKAHLNLHINSLELGDSAVYFCASSSSGARGPYEQYFGPGTRLTVT

SEQ ID NO: 592 - protein, 114 aa, Artificial Sequence
  Synthetic sequence (A11 KRAS TCR_141_3 Valpha)
AQSVAQPEDQVNVAEGNPLTVKCTYSVSGNPYLFWYVQYPNRGLQFLLKYITGDNLVKGSYGFEAEFNKSQTSFHLKKPSALVSDSALYFCAVISGGYNKLIFGAGTRLAVHPY

SEQ ID NO: 593 - protein, 5 aa, Artificial Sequence
  Synthetic sequence (A11 KRAS TCR_141_6 CDR1alpha)
TSINN

SEQ ID NO: 594 - protein, 7 aa, Artificial Sequence
  Synthetic sequence (A11 KRAS TCR_141_6 CDR2alpha)
IRSNERE

SEQ ID NO: 595 - protein, 14 aa, Artificial Sequence
  Synthetic sequence (A11 KRAS TCR_141_6 CDR3alpha)
CATDVFQGAQKLVF

SEQ ID NO: 596 - protein, 5 aa, Artificial Sequence
  Synthetic sequence (A11 KRAS TCR_141_6 CDR1beta)
SGHAT

SEQ ID NO: 597 - protein, 6 aa, Artificial Sequence
  Synthetic sequence (A11 KRAS TCR_141_6 CDR2beta)
FQNNGV

SEQ ID NO: 598 - protein, 13 aa, Artificial Sequence
  Synthetic sequence (A11 KRAS TCR_141_6 CDR3beta)
CASSIETSYEQYF

SEQ ID NO: 599 - DNA, 1493 bp, Artificial Sequence
  Synthetic sequence (A11 KRAS TCR_141_6 TCRbeta-P2A-TCRalpha fragment)
ctcaataaaagagcccacaacccctcactcggcgcgccaccatgggcacaagacttctctgttgggctgctctttgtctgcttggagctgaactgacagaagctggagttgcccagtctcctaggtacaagatcatcgagaagaggcagtctgtggccttttggtgcaatcccattagcggacacgccaccctgtactggtatcagcaaattctgggacaaggccctaaactgctgatccagttccagaacaacggcgtggtggacgattctcaactgcctaaggacaggttttctgccgagagactgaaaggcgtggatagcaccctgaagatccaaccagccaaactggaggattctgctgtgtacctgtgtgctagcagcatcgagaccagctatgagcagtacttcggaccaggcacaagactgacagtgacagaagacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatggagacactgcttggcgtatcactggtgattctgtggctgcaactggctagagtgaactctcagcagggagaagaggatcctcaagctctgagcattcaggaaggcgaaaatgccaccatgaactgcagctacaagaccagcatcaacaacctgcagtggtaccggcagaatagcggaagaggactggttcacctgatcctgatcaggagcaatgaaagggagaagcacagcggcagactgagagttaccctggataccagcaagaagtctagcagcctgctgattacagcctctagagccgccgatacagccagctacttttgtgccacagacgtttttcagggagcccaaaaactggtgtttggacagggcaccaggctgaccatcaatcccaacatccagaatcctgatcctgccgtgtaccagctgcgggacagcaagagcagcgac

SEQ ID NO: 600 - protein, 496 aa, Artificial Sequence
  Synthetic sequence (A11 KRAS TCR_141_6 TCRbeta-P2A-TCRalpha fragment)
QKSPQPLTRRATMGTRLLCWAALCLLGAELTEAGVAQSPRYKIIEKRQSVAFWCNPISGHATLYWYQQILGQGPKLLIQFQNNGVVDDSQLPKDRFSAERLKGVDSTLKIQPAKLEDSAVYLCASSIETSYEQYFGPGTRLTVTEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMETLLGVSLVILWLQLARVNSQQGEEDPQALSIQEGENATMNCSYKTSINNLQWYRQNSGRGLVHLILIRSNEREKHSGRLRVTLDTSKKSSSLLITASRAADTASYFCATDVFQGAQKLVFGQGTRLTINPNIQNPDPAVYQLRDSKSSD

SEQ ID NO: 601 - protein, 113 aa, Artificial Sequence
  Synthetic sequence (A11 KRAS TCR_141_6 Vbeta)
EAGVAQSPRYKIIEKRQSVAFWCNPISGHATLYWYQQILGQGPKLLIQFQNNGVVDDSQLPKDRFSAERLKGVDSTLKIQPAKLEDSAVYLCASSIETSYEQYFGPGTRLTVT

SEQ ID NO: 602 - protein, 113 aa, Artificial Sequence
  Synthetic sequence (A11 KRAS TCR_141_6 Valpha)
SQQGEEDPQALSIQEGENATMNCSYKTSINNLQWYRQNSGRGLVHLILIRSNEREKHSGRLRVTLDTSKKSSSLLITASRAADTASYFCATDVFQGAQKLVFGQGTRLTINPN

SEQ ID NO: 603 - protein, 6 aa, Artificial Sequence
  Synthetic sequence (A11 KRAS TCR_141_7 CDR1alpha)
YGATPY

SEQ ID NO: 604 - protein, 8 aa, Artificial Sequence
  Synthetic sequence (A11 KRAS TCR_141_7 CDR2alpha)
YFSGDTLV

SEQ ID NO: 605 - protein, 12 aa, Artificial Sequence
  Synthetic sequence (A11 KRAS TCR_141_7CDR3alpha)
CAVTGGGNKLTF

SEQ ID NO: 606 - protein, 5 aa, Artificial Sequence
  Synthetic sequence (A11 KRAS TCR_141_7 CDR1beta)
SEHNR

SEQ ID NO: 607 - protein, 6 aa, Artificial Sequence
  Synthetic sequence (A11 KRAS TCR_141_7 CDR2beta)
FQNEAQ

SEQ ID NO: 608 - protein, 14 aa, Artificial Sequence
  Synthetic sequence (A11 KRAS TCR_141_7 CDR3beta)
CASSLAGETGELFF

SEQ ID NO: 609 - DNA, 1493 bp, Artificial Sequence
  Synthetic sequence (A11 KRAS TCR_141_7 TCRbeta-P2A-TCRalpha fragment)
ctcaataaaagagcccacaacccctcactcggcgcgccaccatgggcacatctcttctctgctggatggctctttgtctgcttggagccgatcatgccgatacaggagttagccaggatcctagacacaagatcaccaagagaggccagaatgtgaccttccggtgcgatcctatctctgagcacaacaggctgtactggtacagacaaacactgggacaaggacctgagttcctgacctacttccagaacgaagcccagctggagaagtctagacttctgagcgacagatttagcgccgagagacctaaaggcagctttagcaccctggagatccagagaacagaacagggcgattctgccatgtacctgtgtgcttcttctttggccggcgaaacaggagagctgttttttggagagggctctaggctgacagtgcttgaggacctgaagaacgtgttccccccagaggtggccgtgttcgagcctagcgaggccgagatcagccacacccagaaagccaccctcgtgtgcctggccaccggcttttaccccgaccacgtggaactgtcttggtgggtcaacggcaaagaggtgcacagcggcgtctgcaccgacccccagcccctgaaagagcagcccgccctgaacgacagccggtactgtctgagcagcagactgagagtgtccgccaccttctggcagaacccccggaaccacttcagatgccaggtgcagttctacggcctgagcgagaacgacgagtggacccaggaccgggccaagcccgtgacccagatcgtgtctgctgaggcctggggcagagccgattgcggcttcaccagcgagagctaccagcagggcgtgctgagcgccaccatcctgtacgagatcctgctgggcaaggccaccctgtacgccgtgctggtgtccgccctggtgctgatggccatggtcaagcggaaggacagccggggcggttccggagccacgaacttctctctgttaaagcaagcaggagacgtggaagaaaaccccggtcccatgctgctggaactgatacccctactgggcatccactttgtgctgagaacagctagagcccaatctgtgacacagcccgatatccacattaccgtgagcgaaggagcttctctggaactgagatgcaactacagctatggcgccaccccttaccttttctggtacgtgcagtctcctggacagggattacaactgctgctgaagtacttctccggcgatacactggttcagggcattaagggctttgaggccgagttcaagagaagccagagcagctttaacctgagaaagcctagcgtgcactggtctgatgctgccgagtacttttgtgccgtgacaggaggaggaaataagctgacatttggcaccggaacacagctgaaggtggagctgaatatccagaaccctgaccctgctgtgtaccagctgcgggacagcaagagcagcgac

SEQ ID NO: 610 - protein, 496 aa, Artificial Sequence
  Synthetic sequence (A11 KRAS TCR_141_7 TCRbeta-P2A-TCRalpha fragment)
QKSPQPLTRRATMGTSLLCWMALCLLGADHADTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSLAGETGELFFGEGSRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGGSGATNFSLLKQAGDVEENPGPMLLELIPLLGIHFVLRTARAQSVTQPDIHITVSEGASLELRCNYSYGATPYLFWYVQSPGQGLQLLLKYFSGDTLVQGIKGFEAEFKRSQSSFNLRKPSVHWSDAAEYFCAVTGGGNKLTFGTGTQLKVELNIQNPDPAVYQLRDSKSSD

SEQ ID NO: 611 - protein, 114 aa, Artificial Sequence
  Synthetic sequence (A11 KRAS TCR_141_7 Vbeta)
DTGVSQDPRHKITKRGQNVTFRCDPISEHNRLYWYRQTLGQGPEFLTYFQNEAQLEKSRLLSDRFSAERPKGSFSTLEIQRTEQGDSAMYLCASSLAGETGELFFGEGSRLTVL

SEQ ID NO: 612 - protein, 113 aa, Artificial Sequence
  Synthetic sequence (A11 KRAS TCR_141_7 Valpha)
AQSVTQPDIHITVSEGASLELRCNYSYGATPYLFWYVQSPGQGLQLLLKYFSGDTLVQGIKGFEAEFKRSQSSFNLRKPSVHWSDAAEYFCAVTGGGNKLTFGTGTQLKVELN

SEQ ID NO: 613 - protein, 5 aa, Artificial Sequence
  Synthetic sequence (TCR17_CDR1b)
MDHEN

SEQ ID NO: 614 - protein, 7 aa, Artificial Sequence
  Synthetic sequence (TCR17_ CDR1a)
TRDTTYY

SEQ ID NO: 615 - protein, 6 aa, Artificial Sequence
  Synthetic sequence (TCR17_ CDR2b)
SYDVKM

SEQ ID NO: 616 - protein, 8 aa, Artificial Sequence
  Synthetic sequence (TCR17_ CDR2a)
RNSFDEQN

SEQ ID NO: 617 - protein, 15 aa, Artificial Sequence
  Synthetic sequence (TCR17_CDR3b-short)
CASSLGAGQHNSPLH

SEQ ID NO: 618 - protein, 16 aa, Artificial Sequence
  Synthetic sequence (TCR17_CDR3a-short)
CALSEVHASGGSYIPT

SEQ ID NO: 619 - protein, 5 aa, Artificial Sequence
  Synthetic sequence (TCR14_CDR1b)
SGDLS

SEQ ID NO: 620 - protein, 5 aa, Artificial Sequence
  Synthetic sequence (TCR14_ CDR1a)
TSINN

SEQ ID NO: 621 - protein, 6 aa, Artificial Sequence
  Synthetic sequence (TCR14_ CDR2b)
YYNGEE

SEQ ID NO: 622 - protein, 7 aa, Artificial Sequence
  Synthetic sequence (TCR14_ CDR2a)
IRSNERE

SEQ ID NO: 623 - protein, 14 aa, Artificial Sequence
  Synthetic sequence (TCR14_ CDR3b-short)
CASTHGRDSTDTQY

SEQ ID NO: 624 - protein, 13 aa, Artificial Sequence
  Synthetic sequence (TCR14_ CDR3a-short)
CATDEGGGADGLT

SEQ ID NO: 625-630 - skipped (6 entries)

SEQ ID NO: 631 - protein, 5 aa, Artificial Sequence
  Synthetic sequence (TCR13_CDR1b)
MGHDK

SEQ ID NO: 632 - protein, 6 aa, Artificial Sequence
  Synthetic sequence (TCR13_ CDR1a)
NSAFQY

SEQ ID NO: 633 - protein, 6 aa, Artificial Sequence
  Synthetic sequence (TCR13_ CDR2b)
SYGVNS

SEQ ID NO: 634 - protein, 6 aa, Artificial Sequence
  Synthetic sequence (TCR13_ CDR2a)
TYSSGN

SEQ ID NO: 635 - protein, 12 aa, Artificial Sequence
  Synthetic sequence (TCR13_ CDR3b-short)
CASSEGLYNEQF

SEQ ID NO: 636 - protein, 13 aa, Artificial Sequence
  Synthetic sequence (TCR13_ CDR3a-short)
CAMSASAAGNKLT

SEQ ID NO: 637 - protein, 5 aa, Artificial Sequence
  Synthetic sequence  (TCR22_CDR1b)
MGHDK

SEQ ID NO: 638 - protein, 6 aa, Artificial Sequence
  Synthetic sequence  (TCR22_ CDR1a)
NSAFQY

SEQ ID NO: 639 - protein, 6 aa, Artificial Sequence
  Synthetic sequence  (TCR22_ CDR2b)
SYGVNS

SEQ ID NO: 640 - protein, 6 aa, Artificial Sequence
  Synthetic sequence  (TCR22_ CDR2a)
TYSSGN

SEQ ID NO: 641 - protein, 12 aa, Artificial Sequence
  Synthetic sequence  (TCR22_ CDR3b-short)
CASSQGLYNEQF

SEQ ID NO: 642 - protein, 13 aa, Artificial Sequence
  Synthetic sequence (TCR22_ CDR3a-short)
CAMSAGAAGNKLT

SEQ ID NO: 643 - protein, 5 aa, Artificial Sequence
  Synthetic sequence (TCR19_CDR1b)
SGHDY

SEQ ID NO: 644 - protein, 6 aa, Artificial Sequence
  Synthetic sequence (TCR19_ CDR1a)
NSMFDY

SEQ ID NO: 645 - protein, 6 aa, Artificial Sequence
  Synthetic sequence (TCR19_ CDR2b)
FNNNVP

SEQ ID NO: 646 - protein, 7 aa, Artificial Sequence
  Synthetic sequence (TCR19_ CDR2a)
ISSIKDK

SEQ ID NO: 647 - protein, 14 aa, Artificial Sequence
  Synthetic sequence (TCR19_ CDR3b-short)
CASSPTGGGMLGQY

SEQ ID NO: 648 - protein, 11 aa, Artificial Sequence
  Synthetic sequence (TCR19_ CDR3a-short)
CAASANNNDMR

SEQ ID NO: 649 - protein, 5 aa, Artificial Sequence
  Synthetic sequence (TCR16_CDR1b)
SGHDY

SEQ ID NO: 650 - protein, 6 aa, Artificial Sequence
  Synthetic sequence (TCR16_ CDR1a)
VSNAYN

SEQ ID NO: 651 - protein, 6 aa, Artificial Sequence
  Synthetic sequence (TCR16_ CDR2b)
FNNNVP

SEQ ID NO: 652 - protein, 4 aa, Artificial Sequence
  Synthetic sequence (TCR16_ CDR2a)
GSKP

SEQ ID NO: 653 - protein, 13 aa, Artificial Sequence
  Synthetic sequence (TCR16_ CDR3b-short)
CASSRLGPYNEQF

SEQ ID NO: 654 - protein, 10 aa, Artificial Sequence
  Synthetic sequence (TCR16_ CDR3a-short)
CVLNRDDKII

SEQ ID NO: 655 - protein, 5 aa, Artificial Sequence
  Synthetic sequence (TCR20_CDR1b)
SGHAT

SEQ ID NO: 656 - protein, 7 aa, Artificial Sequence
  Synthetic sequence (TCR20_ CDR1a)
TISGNEY

SEQ ID NO: 657 - protein, 6 aa, Artificial Sequence
  Synthetic sequence (TCR20_ CDR2b)
FQNNGV

SEQ ID NO: 658 - protein, 5 aa, Artificial Sequence
  Synthetic sequence (TCR20_ CDR2a)
GLKNN

SEQ ID NO: 659 - protein, 16 aa, Artificial Sequence
  Synthetic sequence (TCR20_CDR3b-short)
CASSPTFPAGDRDTQY

SEQ ID NO: 660 - protein, 13 aa, Artificial Sequence
  Synthetic sequence (TCR20_ CDR3a-short)
CIVRLNSGNTPLV

SEQ ID NO: 661 - protein, 5 aa, Artificial Sequence
  Synthetic sequence (TCR21_CDR1b)
MGHDK

SEQ ID NO: 662 - protein, 6 aa, Artificial Sequence
  Synthetic sequence (TCR21_ CDR1a)
NSAFQY

SEQ ID NO: 663 - protein, 6 aa, Artificial Sequence
  Synthetic sequence (TCR21_ CDR2b)
SYGVNS

SEQ ID NO: 664 - protein, 6 aa, Artificial Sequence
  Synthetic sequence (TCR21_ CDR2a)
TYSSGN

SEQ ID NO: 665 - protein, 12 aa, Artificial Sequence
  Synthetic sequence (TCR21_CDR3b-short)
CASSVGLYNEQF

SEQ ID NO: 666 - protein, 13 aa, Artificial Sequence
  Synthetic sequence (TCR21_ CDR3a-short)
CAMSGGNAGNMLT

SEQ ID NO: 667 - protein, 5 aa, Artificial Sequence
  Synthetic sequence (TCR24_CDR1b)
SEHNR

SEQ ID NO: 668 - protein, 6 aa, Artificial Sequence
  Synthetic sequence (TCR24_ CDR1a)
TSGFYG

SEQ ID NO: 669 - protein, 6 aa, Artificial Sequence
  Synthetic sequence (TCR24_ CDR2b)
FQNEAQ

SEQ ID NO: 670 - protein, 6 aa, Artificial Sequence
  Synthetic sequence (TCR24_ CDR2a)
NALDGL

SEQ ID NO: 671 - protein, 16 aa, Artificial Sequence
  Synthetic sequence (TCR24_CDR3b-short)
CASSPPGWELAKNIQY

SEQ ID NO: 672 - protein, 11 aa, Artificial Sequence
  Synthetic sequence (TCR24_ CDR3a-short)
CAGGDSSYKLI

SEQ ID NO: 673 - protein, 5 aa, Artificial Sequence
  Synthetic sequence (TCR23_CDR1b)
WNHNN

SEQ ID NO: 674 - protein, 5 aa, Artificial Sequence
  Synthetic sequence (TCR23_ CDR1a)
SVFSS

SEQ ID NO: 675 - protein, 6 aa, Artificial Sequence
  Synthetic sequence (TCR23_ CDR2b)
SYGVQD

SEQ ID NO: 676 - protein, 7 aa, Artificial Sequence
  Synthetic sequence (TCR23_ CDR2a)
VVTGGEV

SEQ ID NO: 677 - protein, 13 aa, Artificial Sequence
  Synthetic sequence (TCR23_CDR3b-short)
CASSEYVGAHEQY

SEQ ID NO: 678 - protein, 16 aa, Artificial Sequence
  Synthetic sequence (TCR23_ CDR3a-short)
CAGVREAGGTSYGKLT

SEQ ID NO: 679 - protein, 6 aa, Artificial Sequence
  Synthetic sequence (TCR15_CDR1b)
GTSNPN

SEQ ID NO: 680 - protein, 6 aa, Artificial Sequence
  Synthetic sequence (TCR15_ CDR1a)
DRGSQS

SEQ ID NO: 681 - protein, 5 aa, Artificial Sequence
  Synthetic sequence (TCR15_ CDR2b)
SVGIG

SEQ ID NO: 682 - protein, 6 aa, Artificial Sequence
  Synthetic sequence (TCR15_ CDR2a)
IYSNGD

SEQ ID NO: 683 - protein, 13 aa, Artificial Sequence
  Synthetic sequence (TCR15_CDR3b-short)
CAWTLTGFGQPQH

SEQ ID NO: 684 - protein, 11 aa, Artificial Sequence
  Synthetic sequence (TCR15_ CDR3a-short)
CAVNARGNMLT

SEQ ID NO: 685 - protein, 235 aa, Artificial Sequence
  Synthetic sequence (CD8 co-receptor alpha chain with signal peptide)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 686 - protein, 210 aa, Artificial Sequence
  Synthetic sequence (CD8 co-receptor beta chain isoform 1 with signal peptide
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 687 - protein, 221 aa, Artificial Sequence
  Synthetic sequence (CD8 co-receptor beta chain isoform 2 with signal peptide)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQLRLHPLEKCSRMDY

SEQ ID NO: 688 - protein, 246 aa, Artificial Sequence
  Synthetic sequence (CD8 co-receptor beta chain isoform 3 with signal peptide)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQKFNIVCLKISGFTTCCCFQILQISREYGFGVLLQKDIGQ

SEQ ID NO: 689 - protein, 246 aa, Artificial Sequence; identical to SEQ ID NO: 688
  Synthetic sequence (CD8 co-receptor beta chain isoform 4 with signal peptide

SEQ ID NO: 690 - protein, 243 aa, Artificial Sequence
  Synthetic sequence (CD8 co-receptor beta chain isoform 5 with signal peptide
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQPQGEGISGTFVPQCLHGYYSNTTTSQKLLNPWILKT

SEQ ID NO: 691 - DNA, 704 bp, Artificial Sequence
  Synthetic sequence (polynucleotide encoding CD8 co-receptor alpha chain)
atggctctgcctgtgacagctctgctgctgcctctggctctgcttctgcatgccgctagacccagccagttcagagtgtcccctctggacagaacctggaacctgggcgagacagtggaactgaagtgccaggtgctgctgagcaatcctaccagcggctgcagctggctgtttcagcctagaggtgctgccgcctctcctacctttctgctgtacctgagccagaacaagcccaaggccgccgaaggactggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgtttctgcccgccaagcctacaacaacccctgctcctagacctcctacaccagctcctacaatcgccagccagcctctgtctctgaggccagaagcttgtagacctgctgctggcggagccgtgcatacaagaggactggatttcgcctgcgacatctacatctgggcccctctggctggaacatgtggcgtgctgctgctgtccctggtcatcaccctgtactgcaaccaccggaacaggcggagagtgtgcaagtgccctagacctgtggtcaagagcggcgacaagcctagcctgagcgccagatatgt

SEQ ID NO: 692 - DNA, 630 bp, Artificial Sequence
  Synthetic sequence (polynucleotide encoding CD8 co-receptor beta chain)
atgaggcctagactgtggctgcttctggctgcccagctgacagtgctgcacggcaattctgtcctgcagcagacccctgcctacatcaaggtgcagaccaacaagatggtcatgctgagctgcgaggccaagatcagcctgtccaacatgcggatctactggctgcggcagagacaggcccctagctctgatagccaccacgagtttctggccctgtgggattctgccaagggcaccattcacggcgaggaagtggaacaagagaagatcgccgtgttccgggacgccagcagattcatcctgaacctgaccagcgtgaagcccgaggacagcggcatctatttctgcatgatcgtgggcagccccgagctgacatttggcaagggaacacagctgagcgtggtggacttcctgcctactacagcccagcctaccaagaagtctaccctgaagaaacgcgtgtgcagactgcccaggcctgagacacaaaagggccctctgtgcagccctatcacactgggattgctggtggctggcgttctggtcctgctggtgtctctgggagttgccatccacctgtgctgtagaagaaggcgggccagactgcggttcatgaagcagttctacaaa

SEQ ID NO: 693 - DNA, 1398 bp, Artificial Sequence
  Synthetic sequence polynucleotide encoding CD8 co-receptor beta chain-self-cleaving peptide-CD8 co-receptor alpha chain)
atggctctgcctgtgacagctctgctgctgcctctggctctgcttctgcatgccgctagacccagccagttcagagtgtcccctctggacagaacctggaacctgggcgagacagtggaactgaagtgccaggtgctgctgagcaatcctaccagcggctgcagctggctgtttcagcctagaggtgctgccgcctctcctacctttctgctgtacctgagccagaacaagcccaaggccgccgaaggactggacacccagagattcagcggcaagagactgggcgacaccttcgtgctgaccctgagcgacttcagaagagagaacgagggctactacttctgcagcgccctgagcaacagcatcatgtacttcagccacttcgtgcccgtgtttctgcccgccaagcctacaacaacccctgctcctagacctcctacaccagctcctacaatcgccagccagcctctgtctctgaggccagaagcttgtagacctgctgctggcggagccgtgcatacaagaggactggatttcgcctgcgacatctacatctgggcccctctggctggaacatgtggcgtgctgctgctgtccctggtcatcaccctgtactgcaaccaccggaacaggcggagagtgtgcaagtgccctagacctgtggtcaagagcggcgacaagcctagcctgagcgccagatatgttggcagcggagaaggcagaggctccctgcttacatgcggcgacgtggaagagaaccccggacctatgaggcctagactgtggctgcttctggctgcccagctgacagtgctgcacggcaattctgtcctgcagcagacccctgcctacatcaaggtgcagaccaacaagatggtcatgctgagctgcgaggccaagatcagcctgtccaacatgcggatctactggctgcggcagagacaggcccctagctctgatagccaccacgagtttctggccctgtgggattctgccaagggcaccattcacggcgaggaagtggaacaagagaagatcgccgtgttccgggacgccagcagattcatcctgaacctgaccagcgtgaagcccgaggacagcggcatctatttctgcatgatcgtgggcagccccgagctgacatttggcaagggaacacagctgagcgtggtggacttcctgcctactacagcccagcctaccaagaagtctaccctgaagaaacgcgtgtgcagactgcccaggcctgagacacaaaagggccctctgtgcagccctatcacactgggattgctggtggctggcgttctggtcctgctggtgtctctgggagttgccatccacctgtgctgtagaagaaggcgggccagactgcggttcatgaagcagttctacaaa

What is claimed is:

1. A method of treating a disease or disorder or preventing a relapse of a disease or disorder associated with a G12-mutant KRAS, NRAS, or HRAS mutation in a subject in need thereof, comprising
administering to said subject an effective amount of a cell population comprising a T cell comprising a membrane protein with a human or humanized extracellular binding domain that is configured to bind to a peptide:HLA complex comprising a G12-mutant KRAS, NRAS, or HRAS peptide, wherein said peptide:HLA complex is HLA-A*11 serotype restricted,
wherein said extracellular binding domain comprises a framework region derived from a human TRBV, TRBD, TRBJ, TRAV, or TRAJ gene segment,
wherein said extracellular binding domain comprises a sequence derived from any one of:
(i) V28-01*01, D1*01F, J1-6*01F, V19*01F, or J6*01F;
(ii) V9-01*01F, D2*02F, J2-3*01F, V17*01F, or J45*01F;
(iii) V25-01*01F, D1*01F, J2-1*01F, V12-3*01F, or J17*01F;
(iv) V25-01*01F, D2*02F, J2-1*01F, V12-3*01F, or J17*01F;
(v) V12-04*01F, D1*01F, J2-3*01F, V29/DV5*01F, or J43*01F;
(vi) V12-04*01F, D2*02F, J2-1*01F, V2*01F, or J30*01F;
(vii) V11-02*01F, D2*02F, J2-3*01F, V26-1*01F, or J29*01F;
(viii) V7-09*01F, D2*01F, J2-4*01, V1-1*01F, J12*01F;
(ix) V25-01*01F, D1*01F, J2-1*01F, V12-3*01F, or J39*01F;
(x) V10-01*01F, D1*01F, J2-7*01F, V27*01F, or J52*01F; or
(xi) V30*02F, D1*01F, J1-5*01F, V12-2*01F, or J39*01F.

2. The method of claim 1, wherein said T cell is configured to undergo an antigen-specific T-cell response to said peptide:HLA complex.

3. The method of claim 2, wherein said T cell is configured to produce IFN-γ when in the presence of said peptide:HLA complex.

4. The method of claim 2, wherein said T cell is configured to have elevated CD137 expression when in the presence of said peptide:HLA complex as compared to CD137 expression in a T cell not expressing said membrane protein.

5. The method of claim 1, wherein said T cell does not substantially produce IFN-γ in the absence of said peptide:HLA complex.

6. The method of claim 1, wherein said G12-mutant KRAS, NRAS, or HRAS peptide comprises any one of (i)
VVVGAVGVGK; (SEQ ID NO.: 2)

(ii)
VVGAVGVGK; (SEQ ID NO.: 3)

(iii)
VVVGADGVGK; (SEQ ID NO.: 5)
or (iv)
VVGADGVGK. (SEQ ID NO.: 4)

7. The method of claim 1, wherein said membrane protein does not comprise a cytoplasmic signaling domain fused thereto.

8. The method of claim 1, wherein said membrane protein has a $\log_{10}$ EC50 for the peptide of less than −8.0, optionally about −8.5 or less, further optionally about −8.5, about −8.6, about −8.7, about −8.8, about −8.9, about −9, about −9.1, or about −9.2.

9. The method of claim 1, wherein said T cell is a CD8+ T cell, a CD4− CD8− double negative T cell, a γδ T cell, or a natural killer T cell.

10. The method of claim 1, wherein said extracellular binding domain comprises a CDR3α and a CDR3β sequence according to:
(i) SEQ ID NOs.:618 or 617;
(ii) SEQ ID NOs.:624 or 623;
(iii) SEQ ID NOs.:636 or 635;
(iv) SEQ ID NOs.:642 or 641;
(v) SEQ ID NOs.:648 or 647;
(vi) SEQ ID NOs.:654 or 653;
(vii) SEQ ID NOs.:660 or 659;
(viii) SEQ ID NOs.:672 or 671;
(ix) SEQ ID NOs.:666 or 665;
(x) SEQ ID NOs.:678 or 677; or
(xi) SEQ ID NOs.:684 or 683.

11. The method of claim 8, wherein said extracellular binding domain comprises a CDR1α and a CDR1β sequence according to
(i) SEQ ID NOs.:614 or 613;
(ii) SEQ ID NOs.:620 or 619;
(iii) SEQ ID NOs.:632 or 631;
(iv) SEQ ID NOs.:638 or 637;
(v) SEQ ID NOs.:644 or 643;
(vi) SEQ ID NOs.:650 or 649;
(vii) SEQ ID NOs.:656 or 655;
(viii) SEQ ID NOs.:668 or 667;

12. The method of claim 1, wherein said extracellular binding domain comprises a Vα or a Vβ region having at least 90% identity to any one of
(i) SEQ ID NOs.:62 or 61;
(ii) SEQ ID NOs.:64 or 63;
(iii) SEQ ID NOs.:68 or 67;
(iv) SEQ ID NOs.:70 or 69;
(v) SEQ ID NOs.:72 or 71;
(vi) SEQ ID NOs.:74 or 73;
(vii) SEQ ID NOs.:76 or 75;
(viii) SEQ ID NOs.:80 or 79;
(ix) SEQ ID NOs.:78 or 77;
(x) SEQ ID NOs.:82 or 81; or
(xi) SEQ ID NOs.:84 or 83.

13. The method of claim 12, wherein said T cell comprises a heterologous polynucleotide sequence encoding said Vα and Vβ region separated by a sequence encoding a self-cleaving peptide.

14. The method of claim 13, wherein said self-cleaving peptide is a P2A, T2A, F2A, E2A peptide, or any combination thereof.

15. The method of claim 1, wherein said subject is HLA-A*11:01 positive.

16. The method of claim 1, further comprising determining a HLA genotype of said subject prior to said administering.

17. The method of claim 1, wherein said cell population comprises CD8+ or CD4+ T cells comprising said membrane protein.

18. The method of claim 1, wherein said disease or disorder comprises a cancer.

19. The method of claim 18, wherein said cancer comprises a solid cancer.

20. The method of claim 18, wherein said cancer comprises a hematological malignancy.

21. The method of claim 19, wherein said solid cancer comprises a pancreatic, lung, or colorectal cancer.

22. The method of claim 18, wherein said cancer is positive for G12-mutant KRAS, NRAS, or HRAS.

23. The method of claim 16, further comprising determining the presence of said G12-mutant KRAS, NRAS, or HRAS mutation in said subject prior to said administering.

24. The method of claim 1, wherein said T cell is autologous to said subject.

25. The method of claim 1, wherein said T cell is allogeneic to said subject.

26. The method of claim 1, wherein said effective amount of said cell population is from about $10^4$ cells/kg to about $10^{11}$ cells/kg.

27. The method of claim 1, wherein said subject has received lymphodepleting chemotherapy prior to said administration.

28. A method of treating a disease or disorder or preventing a relapse of a disease or disorder associated with a G12-mutant KRAS, NRAS, or HRAS mutation in a subject in need thereof, comprising
administering to said subject an effective amount of a cell population comprising a T cell comprising a membrane protein with a human or humanized extracellular binding domain that is configured to bind to a peptide:HLA complex comprising a G12-mutant KRAS, NRAS, or HRAS peptide, wherein said peptide:HLA complex is HLA-A*11 serotype restricted,
wherein said extracellular binding domain comprises a CDR3α and a CDR3β sequence according to:
(i) SEQ ID NOs.:618 or 617;
(ii) SEQ ID NOs.:624 or 623;
(iii) SEQ ID NOs.:636 or 635;
(iv) SEQ ID NOs.:642 or 641;
(v) SEQ ID NOs.:648 or 647;
(vi) SEQ ID NOs.:654 or 653;
(vii) SEQ ID NOs.:660 or 659;
(viii) SEQ ID NOs.:672 or 671;
(ix) SEQ ID NOs.:666 or 665;
(x) SEQ ID NOs.:678 or 677; or
(xi) SEQ ID NOs.:684 or 683.

29. A method of treating a disease or disorder or preventing a relapse of a disease or disorder associated with a G12-mutant KRAS, NRAS, or HRAS mutation in a subject in need thereof, comprising
administering to said subject an effective amount of a cell population comprising a T cell comprising a membrane protein with a human or humanized extracellular binding domain that is configured to bind to a peptide:HLA complex comprising a G12-mutant KRAS, NRAS, or HRAS peptide, wherein said peptide:HLA complex is HLA-A*11 serotype restricted,
wherein said extracellular binding domain comprises a Vα or a Vβ region having at least 90% identity to any one of:
(i) SEQ ID NOs.:62 or 61;
(ii) SEQ ID NOs.:64 or 63;
(iii) SEQ ID NOs.:68 or 67;
(iv) SEQ ID NOs.:70 or 69;
(v) SEQ ID NOs.:72 or 71;
(vi) SEQ ID NOs.:74 or 73;
(vii) SEQ ID NOs.:76 or 75;
(viii) SEQ ID NOs.:80 or 79;
(ix) SEQ ID NOs.:78 or 77;
(x) SEQ ID NOs.:82 or 81; or
(xi) SEQ ID NOs.:84 or 83.

30. The method of claim 29, wherein the Vα and the Vβ region comprise the amino acid sequences of:
(i) SEQ ID NOs.:62 and 61, respectively;
(ii) SEQ ID NOs.:64 and 63, respectively;
(iii) SEQ ID NOs.:68 and 67, respectively;
(iv) SEQ ID NOs.:70 and 69, respectively;
(v) SEQ ID NOs.:72 and 71, respectively;
(vi) SEQ ID NOs.:74 and 73, respectively;
(vii) SEQ ID NOs.:76 and 75, respectively;
(viii) SEQ ID NOs.:80 and 79, respectively;
(ix) SEQ ID NOs.:78 and 77, respectively;
(x) SEQ ID NOs.:82 and 81, respectively; or
(xi) SEQ ID NOs.:84 and 83, respectively.

* * * * *